US012338446B2

(12) United States Patent
Aponte et al.

(10) Patent No.: US 12,338,446 B2
(45) Date of Patent: Jun. 24, 2025

(54) PLANTS HAVING INCREASED TOLERANCE TO HERBICIDES

(71) Applicant: BASF AGRO B.V., Arnhem (NL)

(72) Inventors: Raphael Aponte, Mannheim (DE); Stefan Tresch, Ludwigshafen (DE); Dario Massa, Limburgerhof (DE); Tobias Seiser, Mannheim (DE); Thomas Mietzner, Annweiler (DE)

(73) Assignee: BASF AGRO B.V., Arnhem (NL)

( * ) Notice: Subject to any disclaimer, the term of this patent is extended or adjusted under 35 U.S.C. 154(b) by 335 days.

(21) Appl. No.: 17/855,164

(22) Filed: Jun. 30, 2022

(65) Prior Publication Data

US 2023/0036177 A1 Feb. 2, 2023

Related U.S. Application Data

(63) Continuation of application No. 15/736,423, filed as application No. PCT/IB2016/053512 on Jun. 15, 2016, now abandoned.

(30) Foreign Application Priority Data

Jun. 17, 2015 (EP) .................................... 15172587

(51) Int. Cl.
*C12N 15/82* (2006.01)
*C12N 9/02* (2006.01)

(52) U.S. Cl.
CPC ......... *C12N 15/8274* (2013.01); *C12N 9/001* (2013.01); *C12Y 103/03004* (2013.01)

(58) Field of Classification Search
None
See application file for complete search history.

(56) References Cited

U.S. PATENT DOCUMENTS 4,940,935 A 7/1990 Riley
5,169,770 A 12/1992 Chee et al.
5,188,642 A 2/1993 Shah et al.
5,268,463 A 12/1993 Jefferson
5,276,268 A 1/1994 Strauch et al.
5,322,783 A 6/1994 Tomes et al.
5,349,127 A 9/1994 Dean et al.
5,366,892 A 11/1994 Foncerrada et al.
5,376,543 A 12/1994 Chee et al.
5,380,831 A 1/1995 Adang et al.
5,399,680 A 3/1995 Zhu et al.
5,424,412 A 6/1995 Brown et al.
5,436,391 A 7/1995 Fujimoto et al.
5,466,785 A 11/1995 de Framond
5,561,236 A 10/1996 Leemans et al.
5,565,350 A 10/1996 Kmiec
5,569,597 A 10/1996 Grimsley et al.
5,593,874 A 1/1997 Brown et al.
5,593,881 A 1/1997 Thompson et al.
5,602,321 A 2/1997 John
5,604,121 A 2/1997 Hilder et al.
5,608,142 A 3/1997 Barton et al.
5,608,144 A 3/1997 Baden et al.
5,608,149 A 3/1997 Barry et al.
5,659,026 A 8/1997 Baszczynski et al.
5,723,756 A 3/1998 Peferoen et al.
5,737,514 A 4/1998 Stiffler
5,747,450 A 5/1998 Ohba et al.
5,767,373 A * 6/1998 Ward ...................... A61P 43/00
536/23.6
5,773,702 A 6/1998 Penner et al.
5,792,931 A 8/1998 Duvick et al.
5,859,348 A 1/1999 Penner et al.
5,939,602 A 8/1999 Volrath et al.
5,952,544 A 9/1999 Browse et al.
5,981,722 A 11/1999 Chen et al.
5,990,387 A 11/1999 Tomes et al.
6,027,945 A 2/2000 Smith et al.
6,072,050 A 6/2000 Bowen et al.
6,121,512 A 9/2000 Siminszky et al.
6,177,611 B1 1/2001 Rice
6,232,529 B1 5/2001 Singletary et al.
6,300,544 B1 10/2001 Halkier et al.
6,368,800 B1 4/2002 Smith et al.
(Continued)

FOREIGN PATENT DOCUMENTS

CN 104662155 A 5/2015
EP 0242236 A1 10/1987
(Continued)

OTHER PUBLICATIONS

Larue et al, Pest Manag. Sci. (2020) 76:1031-1038.*
Lee et al (Plant Cell Physiol. (2000) 41:743-749.*
Patzoldt et al, PNAS (2006) 103:12329-12334.*
Rousonelos et al, Weed Science (2012) 60:335-344.*
Nishimura et al, DNA Research (1995) 2:1-8.*
Aldemita et al., "Agrobacterium tumefaciens-mediated transformation of japonica and indica rice varieties", Planta, vol. 199, Issue 4, Aug. 1996, pp. 612-617.
Allison et al., "The nucleotide sequence of the coding region of tobacco etch virus genomic RNA: Evidence for the synthesis of a single polyprotein", Virology, vol. 154, Issue 1, Oct. 15, 1986, pp. 9-20.
Altschul et al., "Basic local alignment search tool", Journal of Molecular Biology, vol. 215, Issue 3, Oct. 1990, pp. 403-410.
(Continued)

*Primary Examiner* — Mykola V. Kovalenko
(74) *Attorney, Agent, or Firm* — MARSHALL, GERSTEIN & BORUN LLP

(57) ABSTRACT

The present invention refers to a method for controlling undesired vegetation at a plant cultivation site, the method comprising the steps of providing, at said site, a plant that comprises at least one nucleic acid comprising a nucleotide sequence encoding a wild-type or a mutated protoporphyrinogen oxidase (PPO) which is resistant or tolerant to a PPO-inhibiting herbicide by applying to said site an effective amount of said herbicide. The invention further refers to plants comprising wild-type or mutated PPO enzymes, and methods of obtaining such plants.

3 Claims, 50 Drawing Sheets

Specification includes a Sequence Listing.

(56) References Cited

U.S. PATENT DOCUMENTS

| | | | |
|---|---|---|---|
| 6,380,465 B1 | 4/2002 | Barrett | |
| 6,649,814 B2 | 11/2003 | Halkier et al. | |
| 6,653,529 B2 | 11/2003 | Peng et al. | |
| 7,250,561 B1 * | 7/2007 | Pallett .................. | C12N 9/0069 800/300 |
| 8,097,774 B2 | 1/2012 | Hawkes et al. | |
| 2003/0233675 A1 | 12/2003 | Cao et al. | |
| 2005/0060767 A1 | 3/2005 | Subramanian et al. | |
| 2005/0246798 A1 | 11/2005 | Castle et al. | |
| 2007/0004912 A1 | 1/2007 | Castle et al. | |
| 2009/0049567 A1 | 2/2009 | Olhoft et al. | |
| 2010/0100988 A1 | 4/2010 | Tranel et al. | |
| 2015/0299725 A1 | 10/2015 | Lerchl et al. | |
| 2016/0194655 A1 | 7/2016 | Aponte et al. | |
| 2016/0374339 A1 | 12/2016 | Aponte et al. | |

FOREIGN PATENT DOCUMENTS

| | | |
|---|---|---|
| EP | 0293356 A1 | 11/1988 |
| EP | 0337899 A1 | 10/1989 |
| EP | 0374753 A2 | 6/1990 |
| EP | 0427529 A1 | 5/1991 |
| EP | 0451878 A1 | 10/1991 |
| EP | 0397687 B1 | 5/1994 |
| EP | 0424047 B1 | 7/1995 |
| EP | 1198985 A1 | 4/2002 |
| WO | WO-93/07256 A1 | 4/1993 |
| WO | WO-93/07278 A1 | 4/1993 |
| WO | WO-93/22443 A1 | 11/1993 |
| WO | WO-94/11516 A1 | 5/1994 |
| WO | WO-95/34656 A1 | 12/1995 |
| WO | WO-1997/032011 A1 | 9/1997 |
| WO | WO-98/33927 A1 | 8/1998 |
| WO | WO-99/43838 A1 | 9/1999 |
| WO | WO-00/15815 A1 | 3/2000 |
| WO | WO-02/15701 A2 | 2/2002 |
| WO | WO-02/068607 A2 | 9/2002 |
| WO | WO-03/018810 A2 | 3/2003 |
| WO | WO-03/052073 A2 | 6/2003 |
| WO | WO-2005/107437 A2 | 11/2005 |
| WO | WO-2006/024820 A1 | 3/2006 |
| WO | WO-2006/037945 A1 | 4/2006 |
| WO | WO-2006/136596 A2 | 12/2006 |
| WO | WO-2007/000077 A1 | 1/2007 |
| WO | WO-2007/024736 A2 | 3/2007 |
| WO | WO-2007/024739 A2 | 3/2007 |
| WO | WO-2007/071900 A1 | 6/2007 |
| WO | WO-2007/096576 A1 | 8/2007 |
| WO | WO-2008/124495 A2 | 10/2008 |
| WO | WO-2008/141154 A2 | 11/2008 |
| WO | WO-2010/049269 A1 | 5/2010 |
| WO | WO-2010/049270 A1 | 5/2010 |
| WO | WO-2012/018862 A2 | 2/2012 |
| WO | WO-2012/080975 A1 | 6/2012 |
| WO | WO-2013/189984 A2 | 12/2013 |
| WO | WO-2014/022636 A1 | 2/2014 |
| WO | WO-2015/022639 A2 | 2/2015 |
| WO | WO-2015/022640 A2 | 2/2015 |
| WO | WO-2015/092706 A1 | 6/2015 |

OTHER PUBLICATIONS

Archer et al., "Current views on chloroplast protein import and hypotheses on the origin of the transport mechanism", Journal of Bioenergetics and Biomembranes, vol. 22, Issue 6, Dec. 1990, pp. 789-810.

Arias et al., "Molecular evolution of herbicide resistance to phytoene desaturase inhibitors in Hydrilla verticillata and its potential use to generate herbicide-resistant crops", Pest Management Science, vol. 61, Issue 3, Mar. 2005, pp. 258-268.

Baim et al., "A chimeric mammalian transactivator based on the lac repressor that is regulated by temperature and isopropyl beta-D-thiogalactopyranoside", Proceedings of the National Academy of Sciences, vol. 88, Issue 12, pp. 5072-5076 (1991).

Ballas et al., "Efficient functioning of plant promoters and poly(A) sites in Xenopus oocytes", Nucleic Acids Research, vol. 17, Issue 19, Oct. 11, 1989, pp. 7891-7903.

Bateman et al., "The Pfam Protein Families Database", Nucleic Acids Research, vol. 30, Issue 1, 2002, pp. 276-280.

Behrens et al., "Dicamba Resistance: Enlarging and Preserving Biotechnology-Based Weed Management Strategies", Science, May 2007, vol. 316, Issue 5828, pp. 1185-1188.

Bevan, "Binary Agrobacterium vectors for plant transformation", Nucleic Acids Research, vol. 12, Issue 22, Nov. 26, 1984, pp. 8711-8721.

Bock, "Transgenic Plastids in Basic Research and Plant Biotechnology", Journal of Molecular Biology, vol. 312, Issue 3, Sep. 21, 2001, pp. 425-438.

Brown et al., "Lac repressor can regulate expression from a hybrid SV40 early promoter containing a lac operator in animal cells", Cell, vol. 49, Issue 5, Jun. 5, 1987, pp. 603-612.

Bucher et al., "A Generalized Profile Syntax for Biomolecular Sequence Motifs and its Function in Automatic sequence Interpretation", Ed. ALTMAN, et al., ISMB-94, Proceedings Second International Conference on Intelligent Systems for Molecular Biology, AAAI Press, Menlo Park, 1994, pp. 53-61.

Buchman et al., "Comparison of intron-dependent and intron-independent gene expression", *Mol. Cell Biol.* 8(10): 4395-405 (1988).

Callis et al., "Introns increase gene expression in cultured maize cells", Genes & Development, vol. 1, Issue 10, 1988, pp. 1183-1200.

Campanella et al., "MatGAT: An application that generates similarity/identity matrices using protein or DNA sequences", BMC Tioinformatics, vol. 4, Issue 29, 2003, pp. 1-4.

Canevascini et al., "Tissue-Specific Expression and Promoter Analysis of the Tobacco Itp1 Gene", Plant Physiology, vol. 112, Issue 2, Oct. 1996, pp. 513-524.

Castle et al., "Discovery and Directed Evolution of a Glyphosate Tolerance Gene", Science, 2004, vol. 304, pp. 1151-1154.

Chan et al., Agrobacterium-mediated production of transgenic rice plants expressing a chimeric alpha-amylase promoter/beta-glucuronidase gene, Plant Mol. Biol., 22(3):491-506 (Jun. 1993).

Chang et al., "Stable genetic transformation of Arabidopsis thaliana by Agrobacterium inoculation in planta", The Plant Journal, vol. 5, Issue 4, Apr. 1994, pp. 551-558.

Che et al., "Localization of target-site of the protoporphyrinogen oxidase-inhibiting herbicide, S-23142, in *Spinacia oleracea* L.", Zeitschrift für Naturforschung, vol. 48c, 1993, pp. 350-355.

Christensen et al., "Sequence analysis and transcriptional regulation by heat shock of polyubiquitin transcripts from maize", Plant Molecular Biology, vol. 12, Issue 6, Jun. 1989, pp. 619-632.

Christensen, et al., "Maize polyubiquitin genes: structure, thermal perturbation of expression and transcript splicing, and promoter activity following transfer to protoplasts by electroporation", Plant Molecular Biology, vol. 18, Issue 4, Feb. 1992, pp. 675-689.

Christopherson et al., "Ecdysteroid-dependent regulation of genes in mammalian cells by a Drosophila ecdysone receptor and chimeric transactivators", Proceedings of the National Academy of Sciences, vol. 89, Issue 14, 1992, pp. 6314-6318.

Clark et al., "Mutations at the transit peptide-mature protein junction separate two cleavage events during chloroplast import of the chlorophyll a/b-binding protein", The Journal of Biological Chemistry, vol. 264, 1989, pp. 17544-17550.

Clough et al., "Floral dip: a simplified method forAgrobacterium-mediated transformation of *Arabidopsis thaliana*", The Plant Journal, vol. 16, Issue 6, Dec. 1998, pp. 735-743.

Cole-Strauss et al., "Targeted gene repair directed by the chimeric RNA/DNA oligonucleotide in a mammalian cell-free extract", Nucleic Acids Research, vol. 27, Issue 5, Mar. 1, 1999, pp. 1323-1330.

Crossway, et al., "Integration of foreign DNA following microinjection of tobacco mesophyll protoplasts", Molecular and General Genetics (MGG), vol. 202, Issue 2, Feb. 1986, pp. 179-185.

(56) References Cited

OTHER PUBLICATIONS

Dailey et al., "Expression of a Cloned Protoporphyrinogen Oxidase", Journal of Biological Chemistry, vol. 269, Jan. 14, 1994, pp. 813-815.
Dayan et al., Biochemical and structural consequences of a glycine deletion in the alpha-8 helix of protoporphyrinogen oxidase, Biochim. Biophys. Acta, 1804(7):1548-56 (Jul. 2010).
Dayan, et al., "Chlorophyll fluorescence as a marker for herbicide mechanisms of action", Pesticide Biochemistry and Physiology, vol. 102, Issue 3, Mar. 2012, pp. 189-197.
De Block, et al., "Transformation of *Brassica napus* and *Brassica oleracea* Using Agrobacterium tumefaciens and the Expression of the bar and neo Genes in the Transgenic Plants", Plant Physiology, vol. 91, Issue 2, Oct. 1989, pp. 694-701.
Deblaere et al., "Efficient octopine Ti plasmid-derived vectors for Agrobacterium-mediated gene transfer to plants", Nucleic Acids Research, vol. 13, Issue 13, Jul. 11, 1985, pp. 4777-4788.
Degenkolb et al., "Structural requirements of tetracycline-Tet repressor interaction: determination of equilibrium binding constants for tetracycline analogs with the Tet repressor", Antimicrobial Agents and Chemotherapy, vol. 35, Issue 8, 1991, pp. 1591-1595.
Della-Cioppa et al., "Protein Trafficking in Plant Cells", Plant Physiology, vol. 84, Issue 4, Aug. 1987, pp. 965-968.
Deuschle et al., "Regulated expression of foreign genes in mammalian cells under the control of coliphage T3 RNA polymerase and lac repressor", Proceedings of the National Academy of Sciences, vol. 86, Issue 14, 1989, pp. 5400-5404.
Deuschle et al., "RNA polymerase Il transcription blocked by *Escherichia coli* lac repressor", Science, vol. 248, Issue 4954, Apr. 27, 1990, pp. 480-483.
Dill et al., "Glyphosate-resistant crops: adoption, use and future considerations", Pest Management Science, vol. 64, Issue 4, Apr. 2008, pp. 326-331.
Duke et al., "Protoporphyrinogen Oxidase-Inhibiting Herbicides", Weed Science, vol. 39, 1991, pp. 465-473.
Elroy-Stein et al., "Cap-independent translation of mRNA conferred by encephalomyocarditis virus 5' sequence improves the performance of the vaccinia virus/bacteriophage T7 hybrid expression system", Proceedings of the National Academy of Sciences, vol. 86, Issue 16, Aug. 1989, pp. 6126-6130.
European Application No. 16811113.6, European Search Report, dated Jan. 15, 2019.
Feldmann et al., Agrobacterium-mediated transformation of germinating seeds of Arabidopsis thaliana: A non-tissue culture approach, Molecular Genetics and Genomics, vol. 208, Issue 1-2, 1987, pp. 1-9.
Figge et al., "Stringent regulation of stably integrated chloramphenicol acetyl transferase genes by *E. coli* lac repressor in monkey cells", Cell, vol. 52, Issue 5, Mar. 11, 1988, pp. 713-722.
Filho et al., "Mitochondrial and chloroplast targeting sequences in tandem modify protein import specificity in plant organelles", Plant Molecular Biology, vol. 30, Issue 4, Feb. 1996, pp. 769-780.
Frame et al., "Agrobacterium tumefaciens-Mediated Transformation of Maize Embryos Using a Standard Binary Vector System", Plant physiology, vol. 129, Issue 1, 2002, pp. 13-22.
Fuerst et al., "Transfer of the inducible lac repressor/operator system from *Escherichia coli* to a vaccinia virus expression vector", Proceedings of the National Academy of Sciences, vol. 86, Issue 8, pp. 2549-2553.
Gallie et al., "The Regulation of Gene Expression in Transformed Maize Aleurone and Endosperm Protoplasts (Analysis of Promoter Activity, Intron Enhancement, and mRNA Untranslated Regions on Expression)", Plant Physiology, vol. 106, Issue 3, Nov. 1994, pp. 929-939.
Gallie et al., "The tobacco etch viral 5? leader and poly(A) tail are functionally synergistic regulators of translation", Gene, vol. 165, Issue 2, 1995, pp. 233-238.
Gasteiger et al., "ExPASy: The proteomics server for in-depth protein knowledge and analysis", Nucleic Acids Research, vol. 31, Issue 13, 2003, pp. 3784-3788.
Geiser et al., "The hypervariable region in the genes coding for entomopathogenic crystal proteins of Bacillus thuringiensis: nucleotide sequence of the kurhd1 gene of subsp. kurstaki HD1", Gene, vol. 48, Isasue 1, 1986, pp. 109-118.
Gill et al., "Negative effect of the transcriptional activator GAL4", Nature, vol. 334, 1988, pp. 721-724.
Gossen et al., "Tight control of gene expression in mammalian cells by tetracycline-responsive promoters", Proceedings of the National Academy of Sciences, vol. 89, Issue 12, 1992, pp. 5547-5551.
Green, "Evolution of Glyphosate-Resistant Crop Technology", Weed Science, vol. 57, Issue 1, 2009, pp. 108-117.
Green, et al., "New multiple-herbicide crop resistance and formulation technology to augment the utility of glyphosate", Pest Management Science, vol. 64, Issue 4, Apr. 2008, pp. 332-339.
Guerineau, et al., "Effect of deletions in the cauliflower mosaic virus polyadenylation sequence on the choice of the polyadenylation sites in tobacco protoplasts", Molecular and General Genetics MGG, vol. 226, Issue 1-2, Apr. 1991, pp. 141-144.
Guevara-Garcia , et al., "Tissue?specific and wound?inducible pattern of expression of the mannopine synthase promoter is determined by the interaction between positive and negative cis ?regulatory elements", The Plant Journal, vol. 4, Issue 3, Sep. 1993, pp. 495-505.
Hansen, et al., "Wound-inducible and organ-specific expression of ORF13 from Agrobacterium rhizogenes; 8196 T-DNA in transgenic tobacco plants", Molecular and General Genetics MGG, vol. 254, Issue 3, Apr. 1997, pp. 337-343.
Hiei, et al., "Efficient transformation of rice (*Oryza sativa* L.) mediated by Agrobacterium and sequence analysis of the boundaries of the T-DNA", The Plant Journal, vol. 6, Issue 2, Aug. 1994, pp. 271-282.
Hofgen, et al., "Storage of competent cells for Agrobacterium transformation", Nucleic Acids Research, vol. 16, Issue 20, Oct. 25, 1988, p. 9877.
Hu, et al., "The inducible lac operator-repressor system is functional in mammalian cells", Cell, vol. 48, Issue 4, Feb. 27, 1987, pp. 555-566.
Hulo, et al., "Recent improvements to the Prosite database", Nucleic Acids Research, vol. 32, Issue suppl. 1, 2004, D134-D137.
International Search Report for PCT Patent Application No. PCT/IB2016/053512, Issued on Oct. 10, 2016, 7 pages.
Inui, et al., "Herbicide resistance in transgenic plants with mammalian P450 monooxygenase genes", Pest Management Science, vol. 61, Issue 3, Mar. 2005, pp. 286-291.
Ishida, et al., "High efficiency transformation of maize (*Zea mays* L.) mediated by Agrobacterium tumefaciens", Nature Biotechnology, vol. 14, Issue 6, pp. 745-750 (1996).
Jobling, et al., "Enhanced translation of chimaeric messenger RNAs containing a plant viral untranslated leader sequence", Nature, vol. 325, 1987, pp. 622-625.
Jones, et al., "Isolation of the tomato Cf-9 gene for resistance to Cladosporium fulvum by transposon tagging", Science, vol. 266, Issue 5186, 1994, pp. 789-793.
Joshi, "Putative polyadenylation signals in nuclear genes of higher plants: a compilation and analysis", Nucleic Acids Research, vol. 15, Issue 23, Dec. 10, 1987, pp. 9627-9640.
Kataoka, et al., "Isolation and Partial Characterization of Mutant Chlamydomanas reinhardtii Resistant to Herbicide S-23142", Journal of Pesticide Science, vol. 15, Issue 3, 1993, pp. 449-451.
Katavic, et al., "In planta transformation of *Arabidopsis thaliana*", Molecular and General Genetics MGG, vol. 245, Issue 3, May 1994, pp. 363-370.
Kawamata, et al., "Temporal and Spatial Pattern of Expression of the Pea Phenylalanine Ammonia-Lyase Genel Promoter in Transgenic Tobacco", Plant and Cell Physiology, vol. 38, Issue 7, Jan. 1, 1997, pp. 792-803.
Klaus, et al., "Generation of marker-free plastid transformants using a transiently cointegrated selection gene", Nature Biotechnology, vol. 22, 2004, pp. 225-229.
Klein, et al., "High-velocity microprojectiles for delivering nucleic acids into living cells", Nature, vol. 327, 1987, pp. 70-73.

(56) References Cited

OTHER PUBLICATIONS

Kleinschmidt, et al., "Dynamics of repressor-operator recognition: The Tn10-encoded tetracycline resistance control", Biochemistry, vol. 27, Issue 4, 1988, pp. 1094-1104.
Krens, et al., "In vitro transformation of plant protoplasts with Ti-plasmid DNA", Nature, vol. 296,1982, pp. 72-74.
Labow, et al., "Conversion of the lac repressor into an allosterically regulated transcriptional activator for mammalian cells", Molecular and Cellular Biology, vol. 10, Issue 7, Jul. 1990, pp. 3343-3356.
Lam, "Analysis of Tissue-Specific Elements in the CaMV 35S Promoter", Plant Promoters and Transcription Factors, Results and Problems in Cell Differentiation book series, vol. 20, 1994, pp. 181-196.
Lamppa, "The chlorophyll a/b-binding protein inserts into the thylakoids independent of its cognate transit peptide", The Journal of Biological Chemistry, vol. 263, 1988, pp. 14996-14999.
Larue et al., Microbial HemG-type protoporphyrinogen IX oxidase enzymes for biotechnology applications in plant herbicide tolerance traits, Pest Manag. Sci., 76(3):1031-8 (Mar. 2020).
Larue et al., Transgenic rice plants expressing a Bacillus subtilis protoporphyrinogen oxidase gene are resistant to diphenyl ether herbicide oxyfluorfen, Plant Cell Physiol., 41(6):743-9 (Jun. 2000).
Last, et al., "pEmu: an improved promoter for gene expression in cereal cells", Theoretical and Applied Genetics, vol. 81, Issue 5, May 1991, pp. 581-588.
Lawrence, et al., "Alterations in the Chlamydomonas Plastocyanin Transit Peptide Have Distinct Effects on in VitroImport and in Vivo Protein Accumulation", The Journal of Biological Chemistry, vol. 272, Issue 33, 1997, pp. 20357-20363.
Lee, et al., "Cellular Localization of Protoporphyrinogen-Oxidizing Activities of Etiolated Barley (*Hordeum; vulgare* L.) Leaves (Relationship to Mechanism of Action of Protoporphyrinogen Oxidase-Inhibiting; Herbicides)", Plant Physiology, vol. 102, 1993, pp. 881-889.
Letunic, et al., "Recent improvements to the SMART domain-based sequence annotition resource", Nucleic Acids Research, vol. 30, Issue 1, 2002, pp. 242-244.
Li, et al., "Development of PPO inhibitor-resistant cultures and crops", Pest Management Science, vol. 61, Issue 3, Mar. 2005, pp. 277-285.
Linsmaier, et al., "Organic Growth Factor Requirements of Tobacco Tissue Cultures", Physiologia Plantarum, vol. 18, Issue 1, Jan. 1965, pp. 100-127.
Lommel, et al., "Identification of the Maize chlorotic mottle virus capsid protein cistron and characterization of its subgenomic messenger RNA", Virology, vol. 181, Issue 1, Mar. 1991, pp. 382-385.
Macejak, et al., "Internal initiation of translation mediated by the 5? leader of a cellular mRNA", Nature, vol. 353, 1991, pp. 90-94.
Maliga, "Progress towards commercialization of plastid transformation technology", Trends in Biotechnology, vol. 21, Issue 1, Jan. 2003, pp. 20-28.
Martin, et al., "Map-based cloning of a protein kinase gene conferring disease resistance in tomato", Science, vol. 262, Issue 5138, 1993, pp. 1432-1436.
Matringe, et al., "p-Hydroxyphenylpyruvate dioxygenase inhibitor-resistant plants", Pest Management Science, vol. 61, Issue 3, Mar. 2005, pp. 269-276.
Matringe, et al., "Protoporphyrinogen oxidase as a molecular target for diphenyl ether herbicides", ?Biochemical Journal, vol. 260, Issue 1, 1989, pp. 231-325.
Matringe, et al., "Protoporphyrinogen oxidase inhibition by three peroxidizing herbicides: oxadiazon, LS 82-556 and M&B 39279", FEBS Letters, vol. 245, Issues 1-2, 1989, pp. 35-38.
Matsuoka, et al.,"Tissue-specific light-regulated expression directed by the promoter of a C4 gene, maize pyruvate, orthophosphate dikinase, in a C3 plant, rice", Proceedings of the National Academy of Sciences, vol. 90, Issue 20, 1993, pp. 9586-9590.
McBride, et al., "Controlled expression of plastid transgenes in plants based on a nuclear DNA-encoded and plastid-targeted T7 RNA polymerase", Proceedings of the National Academy of Sciences, vol. 91 Issue 15, 1994, pp. 7301-7305.
McElroy, et al., "Isolation of an efficient actin promoter for use in rice transformation", The Plant Cell, vol. 2, Issue 2, Feb. 1990, pp. 163-171.
Mindrinos, et al., "The *A. thaliana* Disease Resistance Gene RPS2 Encodes a Protein Containing a Nucleotide-Binding Site and Leucine-Rich Repeats", Cell, vol. 78, issue 6, 1994, pp. 1089-1099.
Mlynarova, et al., "High efficiency Agrobacterium-mediated gene transfer to flax", Plant Cell Reports, vol. 13, Issue 5, Feb. 1994, pp. 282-285.
Mogen, et al., "Upstream sequences other than AAUAAA are required for efficient messenger RNA 3'-end formation in plants", The Plant Cell, vol. 2, Issue 12, Dec. 1990, pp. 1261-1272.
Moloney, et al., "High efficiency transformation of *Brassica napus* using Agrobacterium vectors", Plant Cell Reports, vol. 8, Issue 4, Apr. 1989, pp. 238-242.
Mulder, et al., "The InterPro Database, 2003 brings increased coverage and new features", Nucleic Acids Research, vol. 31, Issue 1, 2003, pp. 315-318.
Munroe, et al., "Tales of poly(A): a review", Gene, vol. 91, Issue 2, Jul. 16, 1990, pp. 151-158.
Murashige, et al., "A Revised Medium for Rapid Growth and Bio Assays with Tobacco Tissue Cultures", Physiologia Plantarum, vol. 15, Issue 3, Jul. 1962, pp. 473-497.
Murray, et al., "Codon usage in plant genes", Nucleic Acids Research, vol. 17, Issue 2, Jan. 25, 1989, pp. 477-498.
Nandihalli, et al., "Quantitative Structu re-Activity Relationships of Protoporphyrinogen Oxidase-Inh ibiting Diphenyl Ether Herbicides", Pesticide Biochemistry and Phasiology, vol. 43, Issue 3, 1992, pp. 193-211.
Needleman, et al., "A general method applicable to the search for similarities in the amino acid sequence of two proteins", Journal of Molecular Biology, vol. 48, issue 3, pp. 443-453.
Negrutiu, et al., "Hybrid genes in the analysis of transformation conditions", Plant Molecular Biology, vol. 8, Issue 5, Sep. 1987, pp. 363-373.
Nishimura et al., Cloning and identification of the hemG gene encoding protoporphyrinogen oxidase (PPO) of *Escherichia coli* K-12, DNA Res., 2(1):1-8 (1995).
Odell, et al., "Identification of DNA sequences required for activity of the cauliflower mosaic virus 35S promoter", Nature, vol. 313, pp. 810-812 (1985).
Oliva, et al., "Evidence that tetracycline analogs whose primary target is not the bacterial ribosome cause lysis of *Escherichia coli*", Antimicrobial Agents and Chemotherapy, vol. 36, Issue 5, 1992, pp. 913-919.
Orozco, et al., "Localization of light-inducible and tissue-specific regions of the spinach ribulose bisphosphate carboxylase/oxygenase (rubisco) activase promoter in transgenic tobacco plants", Plant Molecular Biology, vol. 23, Issue 6, Dec. 1993, pp. 1129-1138.
Oshio, et al., "Isolation and Characterization of a Chlamydomonas reinhardtii Mutant Resistant to Photobleaching Herbicides", Zeitschrift für Naturforschung, vol. 48C, Issue 3-4, 1993, pp. 339-344.
Padgette, et al., "Site-directed Mutagenesis of a Conserved Region of the; 5-Enolpyruvylshikimate-3-phosphate Synthase Active Site", Journal of Biological Chemistry, vol. 266, Issue 33, 1991, pp. 22364-22369.
Patzoldt et al., A codon deletion confers resistance to herbicides inhibiting protoporphyrinogen oxidase, Proc. Natl. Acad. Sci. USA, 103(33):12329-34 (Aug. 2006).
Potrykus, "Gene Transfer to Plants: Assessment of Published Approaches and Results", Annual Review of Plant Physiology and Plant Molecular Biology, vol. 42, 1991, pp. 205-225.
Proudfoot, "Poly(A) signals", Cell, vol. 64, Issue 4, 1991, pp. 671-674.
Reines, et al., "Elongation factor Sll-dependent transcription by RNA polymerase II through a sequence-specific DNA-binding protein", Proceedings of the National Academy of Sciences, vol. 90, Issue 5, 1993, pp. 1917-1921.
Reznikoff, "The lactose operon?controlling elements: a complex paradigm", vol. 6, Issue 17, Sep. 1992, pp. 2419-2422.

(56) References Cited

OTHER PUBLICATIONS

Rinehart, et al., "Tissue-Specific and Developmental Regulation of Cotton Gene FbL2A (Demonstration of Promoter Activity in Transgenic Plants)", Plant Physiology, vol. 112, Issue 3, Nov. 1996, pp. 1331-1341.
Romer, et al., "Expression of the Genes Encoding the Early Carotenoid Biosynthetic-Enzymes in Capsicum annuum", Biochemical and Biophysical Research Communications, vol. 196, Issue 3, Nov. 15, 1993, pp. 1414-1421.
Rousonelos et al., Characterization of a Common Ragweed (*Ambrosia artemisiifolia*) Population Resistant to ALS- and PPO-Inhibiting Herbicides, Weed Sci., 60(3):335-44 (2012).
Russell, et al., "Tissue-specific expression in transgenic maize of four endosperm promoters from maize and rice", Transgenic Research, Mar. 1997, vol. 6, Issue 2, pp. 157-168.
Sanfacon, et al., "A dissection of the cauliflower mosaic virus polyadenylation signal", Genes & Development, 1991, vol. 5, pp. 141-149.
Sasarmen, et al., "Nucleotide sequence of the hemG gene involved in the protoporphyrinogen oxidase activity of *Escherichia coli* K12", Canadian Journal of Microbiology, vol. 29, Issue 12, 1993, pp. 1155-1161.
Sato, et al., "Characterization of a Mutant of Chlamydomonas reinhardtii Resistant to rotoporphyrinogen Oxidase Inhibitors", Ed. S.Duke, ACS Symposium on Porphyrid Pesticides, Chapter 7, 1994, pp. 91-104.
Schenk, et al., "SeSaM: Sättigungsmutagenese eines Genes", Biospektrum, vol. 12, Mar. 2006, pp. 277-279.
Schmidt, et al., "A novel operon organization involving the genes for chorismate synthase (aromatic biosynthesis pathway) and ribosomal GTPase center proteins (L11, L1, L10, L12: rpIKAJL) in cyanobacterium Synechocystis PCC 6803", The Journal of Biological Chemistry, vol. 268, Issue 36, 1993, pp. 27447-27457.
Schnell, et al., "Signal peptide analogs derived from two chloroplast precursors interact with the signal recognition system of the chloroplast envelope", The Journal of Biological Chemistry, vol. 266, Issue 5, 1991, pp. 3335-3342.
Schubert, et al., "Cloning of the Alcaligenes eutrophus genes for synthesis of poly-beta-hydroxybutyric acid (PHB) and synthesis of PHB in *Escherichia coli*", ?Journal of Bacteriology, vol. 170, Issue 12, 1988, pp. 5837-5847.
Schultz, et al., "SMART, a simple modular architecture research tool: Identification of signaling domains", Proceedings of the National Academy of Sciences USA, vol. 95, Issue 11, May 1998, pp. 5857-5864.
Shah, et al., "Engineering Herbicide Tolerance in Transgenic Plants", Science, vol. 233, Issue 4762, Jul. 25, 1986, pp. 478-481.
Shibata, et al., "Isolation And Characterization of a Chlamydomonas Reinhardtii Mutant Resistant to an Experimental Herbicides-23142, Which Inhibits Chlorophyll Synthesis", Ed. N. Murata, Research in Photosynthesis, vol. III, 1992, pp. 567-570.
Shillito, et al., "High Efficiency Direct Gene Transfer to Plants", Bio/Technology, vol. 3, 1985, pp. 1099-1103.
Siminszky, "Plant cytochrome P450-mediated herbicide metabolism", Phytochemistry Reviews, vol. 5, Issue 2-3, Jun. 2006, pp. 445-458.
Smith, et al., "Identification of Common Molecular Subsequences", Journal of Molecular Biology, vol. 147, Issue 1, Mar. 1981, pp. 195-197.
Staub, et al., "Accumulation of D1 polypeptide in tobacco plastids is regulated via the untranslated region of the psbA mRNA", The EMBO Journal, vol. 12, Issue 2, Feb. 1993, pp. 601-606.
Strepp, et al., "Plant nuclear gene knockout reveals a role in plastid division for the homolog of the bacterial; cell division protein FtsZ, an ancestral tubulin", Proceedings of the National Academy of Sciences, vol. 95,; Issue 8, 1998, pp. 4368-4373.
Svab, et al., "Stable transformation of plastids in higher plants", Proceedings of the National Academy of Sciences, vol. 87, Issue 21, 1990, pp. 8526-8530.
Svab, et al., "High-frequency plastid transformation in tobacco by selection for a chimeric aadA gene", Proceedings of the National Academy of Sciences, vol. 90, Issue 3, 1993, pp. 913-917.
Tan, et al., "Imidazolinone-tolerant crops: history, current status and future", Pest Management Science, vol. 61, Issue 3, Mar. 2005, pp. 246-257.
Terpe, et al., "Overview of tag protein fusions: from molecular and biochemical fundamentals to commercial systems", Applied Microbiology and Biotechnology, vol. 60, Issue 5, 2003, pp. 523-533.
Thomas, et al., "Site-directed mutagenesis by gene targeting in mouse embryo-derived stem cells", Cell, vol. 51, Issue 3, Nov. 6, 1987, pp. 503-512.
Van Camp, et al., "Tissue-Specific Activity of Two Manganese Superoxide Dismutase Promoters in Transgenic Tobacco", Plant Physiology, vol. 112, Issue 2, Oct. 1996, pp. 525-535.
Van Damme, et al., "Molecular cloning of mannose-binding lectins from Clivia miniata", Plant Molecular Biology, vol. 24, Issue 5, 1994, pp. 825-830.
Velten, et al., "Isolation of a dual plant promoter fragment from the Ti plasmid of Agrobacterium tumefaciens", The EMBO Journal, vol. 3, Issue 12, Dec. 1984, pp. 2723-2730.
Voinnet, et al., "Retracted: an enhanced transient expression system in plants based on suppression of gene silencing by the p19 protein of tomato bushy stunt virus", vol. 33, Issue 5, Mar. 2003, pp. 949-956.
Von Heijne, et al., "CHLPEP-A database of chloroplast transit peptides", Plant Molecular Biology Reporter, vol. 9, Issue 2, May 1991, pp. 104-126.
Williams, et al., "Differences in zoospore germination and host penetration in response to temperature among Western Australian isolates of Plasmopara viticola", Australian Journal of Agricultural Research, vol. 58, Issue 7, pp. 702-710.
Wyborski, et al., "Analysis of inducers of the *E.coli* lac repressor system mammalian cells and whole animals", Nucleic Acids Research, vol. 19, Issue 17, Sep. 11, 1991, pp. 4647-4653.
Yamamoto, et al., "Light-responsive elements of the tobacco PSI?D gene are located both upstream and within the transcribed region", The Plant Journal, vol. 12, Issue 2, Aug. 1997, pp. 255-265.
Yamamoto, et al., "The Promoter of a Pine Photosynthetic Gene Allows Expression of a ?-Glucuronidase Reporter Gene in Transgenic Rice Plants in a Light-Independent but Tissue-Specific Manner", Plant and Cell Physiology, vol. 35, Issue 5, Jan. 1, 1994, pp. 773-778.
Yanase, et al., "Porphyrin synthesis involvement in diphenyl ether-like mode of action of TNPP-ethyl, a novel phenylpyrazole herbicide", Pesticide Biochemistry and Physiology, vol. 35, Issue 1, 1989, pp. 70-80.
Yao, et al., "*Drosophila* ultraspiracle modulates ecdysone receptor function via heterodimer formation", Cell, vol. 71, Issue 1, Oct. 1992, pp. 63-72.
Zambretti, et al., "A mutant p53 protein is required for maintenance of the transformed phenotype in cells transformed with p53 plus ras cDNAs", Proceedings of the National Academy of Sciences, vol. 89, Issue 9, pp. 3952-3956 (1992).
Zhao, et al., "Immunological Characterization and Chloroplast Localization of the Tryptophan Biosynthetic Enzymes of the Flowering Plant *Arabidopsis thaliana*", The Journal of Biological Chemistry, vol. 270, Issue 11, pp. 6081-6087.
Lee et al., Transgenic rice plants expressing a Bacillus subtilis protoporphyrinogen oxidase gene are resistant to diphenyl ether herbicide oxyfluorfen, Plant Cell Physiol., 41(6):743-9 (2000).

* cited by examiner

Figure 1a

```
SEQ ID NO:                            10        20        30        40        50        60        70
   1 88809979[Amaranthus     ..MVIQSITHLSPNLALPSPLSVSTKNYPVAVMGNISEREEPTSAKR.A.V...V..AAA.K.KSH.L..
   2 PPO[Salinibacter_ru     ...............................................MPN.GII.....IA..AAA.R.QEH.H.
   3 PPO[Rhodothermus_ma     ................................................MAS.GII.....IA..TAA.E.HRR.L.
   4 PPO[Salinibacter_ru     ...............................................MPN.GII.....IA..AAA.R.QEH.H.
   5 PPO[Rhodothermus_ma     ................................................MAS.GII.....IA..AAA.E.HRR.L.
   6 PPO[Halothio_bacill     ........................................MNTHSNASEPINCPYL.I...I...AT..H.SRM.K.
   7 YP_003547456PPO[Cor     ..................................................MPDTCI....IT..ATWQYQRK.K.
   8 YP_863962PPO[Magnet     ...................................................MTKNPILI......ST.WF.HKK.E.
   9 YP_001819575PPO[Opi     .........................................MSTSPFNPSATASGRPPKTFA.L...IT..TA.HR.TQL.H.
  10 YP_006526861PPO[Mel     ...................................................MSKKIV.L....I...ST.W.VKK.Y.
  11 XP_001760919[Physco     ..............................................................A.V...V...AA.HR.RSA.V.
  12 XP_002509548_amineo     ..........................................MSSVIKEDRNPSHVKR.A.V...V...AAA.K.KSH.L.
  13 YP_572852PPO[Chromo     .................................MQHEEQLDATDQAVGEARRD.V.V.GCAS...AAA.RAAARR.L.
  14 YP_006766810PPO[Lep     ..............................................MAGFDCDTL.V.G.V...AAA.LT.KNR.V.
  15 YP_002984571[Selagi     ............................................MAMAEGETVPVLGS.A.V...A...AAA.R.AAA.V.
  16 XP_002978633[Selagi     ............................................MAMAEGETAPVLGS.A.V...A...AAA.R.AAA.V.
  17 NP_196926PPO-likepr     ..........................................MASGAVADHQIEAVSGKR.A.V...V...AAA.K.KSR.L.
  18 YP_004749312PPO(X)a     ..................................................MSSET.I.V...LT..SATWY.HQR.I.
  19 XP_002873656_HEMG2_     ..........................................MESGAVGDHDTKFESISGKR.A.V...V...AAA.K.KSR.L.
  20 NP_001236376_PPOX[G     ............................................MASSATDDNPRSVKR.A.V...V...AAA.K.KSH.L.
  21 YP_002568450PPO[Chl     ...............................................MMAGYDSV.I.G.IA...AAA.Y.HKR.Y.
  22 XP_003622202PPO[Med     ............................................MASSAKDDNPRSVKR.A.V...V...AAA.K.KSH.L.
  23 XP_002464647PPO[Chl     ................................................MMMANYDSV.I.G.I...AAA.Y.YKR.Y.
  24 XP_002263321_PPO_mi     ...........................................MAEKSDAQSHYNGSGKR.A.V...V...AAA.K.KLH.V.
  25 NP_001105004_PPOX(m     MLALTASASSASSHPYRHASAHTRRPRLRAVLAMAGSDDPRAAPARS.A.V...V...AAA.R.RQS.V.
  26 NP_001190307_[Arabi     ..........................................MASGAVADHQIEAVSGKR.A.V...V...AAA.K.KSR.L.
  27 YP_003433215PPO[Hyd     ......................................................MID.X.V...I...S.H.KKA.L.
  28 YP_004151624PPO[The     ..................................................MR.C.I...V...ST.FY.KRG.A.
  29 YP_005845210PPO[Ign     ...................................................MTKTIV.I...I...TT..L.SKR.F.
  30 XP_002446710_06g020     MLARTATVSSTSSHSHPYRPTSARSLRLRPVLAMAGSDDSRAAPARS.A.V...V...VAA.R.RKS.V.
  31 YP_004231001PPO[Des     ......................................................MK.A.I...I...SV.FY.KKG.A.
  32 YP_004734657PPO[Aci     .....................................................MED.II.I...I...AT.Y.FRK.W.
  33 YP_003474039PPO[The     .....................................................MMD.I.V...I...SV.FR.SKE.L.
  34 YP_002796374PPO[Lar     .......................................................M.V.I...I...SC.WH.QQR.I.
  35 YP_002219182PPO[Aci     .....................................................MEE.II.I...I...AT.Y.FRK.W.
  36 YP_003496573PPO[Def     ........................................................MKIAI.G.I...IST.FW.EYFAKE
  37 YP_001228933PPO[Geo     .........................................................MKKAI.V...I...AS..L.REKAKN
  38 YP_002248561PPO[The     .........................................................MGSAEIVIV...I...SL..F.IQKNS.
   Consensus                                                                      V V GAG SGL  AY L   G
```

Figure 1a continued

```
SEQ ID NO:
                                       80        90        100       110       120       130       140
 1 88809979[Amaranthus    .....SVTLFEADSRAGGKLK.TVKKDGFIWDEGANTMTESEAE....VSSLIDDL.GLREKQQLPIS.Q
 2 PPO[Salinibacter_ru    .....SVRVLEASGHTGGVIR.SESSEGFLVEHGPNSIRAGAAG....LETLIDAL.DLHEDRVWANDAA
 3 PPO[Rhodothermus_ma    .....EVTVFEATDRIGGFIQ.SERIDGFLVELGPQTLQRTSGD....FEELRQV.DLEDACIPARPVA
 4 PPO[Salinibacter_ru    .....SVRLLEASGHTGGVIR.SESSEGFLVEHGPNSIRAGAAG....LETLIDAL.DLHEDRVWANDAA
 5 PPO[Rhodothermus_ma    .....EVTVFEATDRIGGFIQ.SERIDGFLVEHGPQTLQRTSGD....FEELRQV.DLEDACITARPIA
 6 PPO[Halothio_bacil     .....TVTVLEATSRVGGAVG.SIEEDGWLRELGPNSLVQT.PE....MAALMSAL.DLVSEIIEANTVA
 7 YP_003547456PPO[Cor    .....DCVVLESGPQVGGAIQ.SILQDGYLAEEGPNSIQLNSLE....IEDFLTSIPGLEAQIIEANPAA
 8 YP_863962PPO[Magnet    .....KVILLESRDRVGGNIRTSRNPEGYLIEHGPNSTLQKPGDEEDALGRIITDM.ALESELQEANPLA
 9 YP_001819575PPO[Opi    .....KVRVFEQSDRVGGSIK.TEEVDGWLIEGGPNTLLSGELA....VDKLIDEL.GLNGERIAADPAA
10 YP_006526861PPO[Mel    .....DVTILETKNEPGGSMI.SRRLDNFLIDYGPNSGLETTPL....IRKLVEEV.NLSDKMIYANAAA
11 XP_001760919[Physco    .....AVTVFEAQNAVGGKIQ.SFSNDGLIWEQGPNTMVETEPE....VSSLIDEL.GLREKQQWPVM.Q
12 XP_002509548_amineo    .....KVTVFEAEERAGGKLR.SVNHDGLIWDEGANTMTESEME....VKSLIGNL.GIREKQQFPIS.Q
13 YP_572852PPO[Chromo    .....AVSVLERGSHAGGNLR.THRDGAWQVEVGPNTLVMKPP.....LHTLLDEL.GLLDEAQPANPDA
14 YP_006766810PPO[Lep    .....DVRLLESRGYLGGAIR.TVREDGYLLEFGPNSLMVRPED...AIDTVLGDP.ELRARIVPASGLS
15 XP_002984571[Selagi    .....SVTVYEAENSIGGKLK.SVSENGFIWEKGPNTMTENDPS....ISRMFDDL.HLRDKQQFPVE.Q
16 XP_002978633[Selagi    .....SVTVYEAENSIGGKLK.SVSENGFIWEKGPNTMTENDPS....ISRMFDDL.HLRDKQQFPVE.Q
17 NP_196926PPO-likepr    .....NVTVFEADGRVGGKLR.SVMQNGLIWDEGANTMTEAEPE....VGSLLDDL.GLREKQQFPIS.Q
18 YP_004749312PPO(X)a    .....PALLLEAEAEVGGNLR.SRSEDGFLRDLGPNSLMIKGDL....LPDLIRQL.QLEDRVVEANPLA
19 XP_002873656_HEMG2_    .....NVTVFEADERAGGKLT.SVMQNGLIWDQGANTMTEAEPE....VGSLLDDL.GLRDKQQFPIS.Q
20 NP_001236376_PPOX[G    .....DVTVFEAEGRAGGRLR.SVSQDGLIWDEGANTMTESEIE....VKGLIDAL.GLQEKQQFPIS.Q
21 YP_002568450PPO[Chl    .....RVLVIESTNRVGGVIQTITTPEGYILDCGPNTVGTGDAR....LWQELIDL.GLRERITPAAPCS
22 XP_003622202PPO[Med    .....DVTVFEAEGRAGGRLR.TVSRDGLVWDEGANTMTENEIE....VKGLIDAL.GLHEKQQYPLS.Q
23 YP_002464647PPO[Chl    .....RVLVIEAANRVGGVIHSITTPEGFTLDCGPNTIGTNDVR....LWQELIDL.GLRDRIRPAARCG
24 XP_002263321_PPO_mi    .....NITLYEAEERAGGKLR.SVSQHGLVWDEGANTMTESEIE....VGSLLDNL.RLREKQQFPIS.Q
25 NP_001105004_PPOX(m    .....NVTVFEAADRAGGKIR.TNSEGGFVWDEGANTMTEGEWE....ASRLIDDL.GLQDKQQYPNS.Q
26 NP_001190307_[Arabi    .....NVTVFEADGRVGGKLR.SVMQNGLIWDEGANTMTEAEPE....VGSLLDDL.GLREKQQFPIS.Q
27 YP_003433215PPO[Hyd    .....EVKVFEKEDAVGGNIQ.TAYIDGYVCELGPQTIL.ADSK....VEEFLKDA.GIKP..IYANPSS
28 YP_004151624PPO[The    .....QVKLLERENYPGGKAR.TYYEKGYIVESGPNGFLDGKPD....TLELVKLL.GAEKLLYRSSDKA
29 YP_005845210PPO[Ign    .....NIRILERKSEVGGSIE.SIKENGFLFDRGPNSALETTPL....ISQLVEEL.NLKDELLYANKAA
30 XP_002446710_06g020    .....NVTVFEAADRAGGKIR.TNSEGGFLWDEGANTMTEGELE....ASRLIDDL.GLQDKQQYPNS.Q
31 YP_004281001PPO[Des    .....EVKVFEKEKTVGGKMK.TIHEDGYIIETGPNGFLDGKPY....TLNLVKEL.GIESKLYRSSDKA
32 YP_004784657PPO[Aci    .....SPLLLEAAAKPGGNLQ.SRQEEGYLRDMGPNSLMLKGHI....VPEWLREL.RLEEDIVEANPLA
33 YP_003474039PPO[The    .....KVKVLEKEEEPGGNIR.TRKVGDFLCELGPQTVL.ADGE....VVDFFREV.GIQP..QEASPSS
34 YP_002796374PPO[Lar    .....PVVVLEAGSRVGGKIG.TVAADGYRLELGPNTLYGHAGH.....LDLLERL.GLTAAIRPAAAVV
35 YP_002219182PPO[Aci    .....SPLLLEAGAAPGGNLQ.SRQEEGYLRDMGPNSLMLKGRI....VPEWLREL.QLEGDIVEANPLA
36 YP_003496573PPO[Def    RLKSIDITIFEKNKRLGGTIN.TFYKDNFIIESGPNGFLDSKPY....TVETFEKA.GLGDNLIRSNELA
37 YP_001228933PPO[Geo    SGMELEITIVEKEDRTGGKIR.SIKEDGYLCEWGPNGFLDSKPQ....TLDLCREL.KVDSQLLRSNDNA
38 YP_002248561PPO[The    ...QLNIKIVEAEKRAGGKII.TENISGFLCEGGVNGFLSNKPS....TISLAKEL.NIEP..LRGSESS
   Consensus                   V   E     GG         G     GPN                L   L  L

SEQ ID NO:
                                   150       160       170       180       190       200       210
 1 88809979[Amaranthus    NKRYIA.RDGLPVLLPSNPAALLTSNILSAKSKLQIMLE..PFLWRKHN...ATELSDEHVQESVGEFFE
 2 PPO[Salinibacter_ru    DTRYVV.RDGRPTPLPRSVGSFLTTDLFSTRAKLRLLAE..PF.........IGRAAA..EDESVARFTE
 3 PPO[Rhodothermus_ma    ANRFIV.RGGQPIPLPRSPRELLRTPLLSPRARLRLLAE..PF.........IHRAHR.STEESVAKFTR
 4 PPO[Salinibacter_ru    DTRYVV.RDGRPTPLPRSVGSFLTTDLFSTRAKLRLLAE..PF.........IGRAAA..EEESVARFTE
 5 PPO[Rhodothermus_ma    ANRFIV.RGGRPIPLPRSPRELLRTPLLSPRARLRLLAE..PF.........IHRAHR.STEESVAKFAR
 6 PPO[Halothio_bacil     KKRFVA.KNGHPVALPGSPLELLTSPLFSMGDLWHLARE..AW.........IKPVNK...ESTIAEFVR
 7 YP_003547456PPO[Cor    QKRYIV.RKGRLRAVPMNPLQAITTQLWSIAGKLRVLRE..PF.........IKAAPP.EPDQSVADFVT
 8 YP_863962PPO[Magnet    ARRFVM.KGGQLHVLPTSPPGFIKTPLFSLSAKLRLCLE..PF.........IGKSEQ...EKSIAQFVI
 9 YP_001819575PPO[Opi    KNRYIV.RRGRALAAPMSPPSFFASSLFSPVAKFKLLAE..LF.........ARRRVR.TTDVSLAEFVE
10 YP_006526861PPO[Mel    SKRYIL.KNGELIPLPMSPGSFIRTKLFSSGAKFRLMAE..PF.........VSKSDD.GYYQSIAEFVR
11 XP_001760919[Physco    NKRYVV.RDGKAVQLPSNPLGLITTKLLSAQAKCQILLE..PFLWKRKE...VPLKEAANGRENVGNFIT
12 XP_002509548_amineo    NKRYIV.RNGKPILIPTNPIALITSNILSAQSKFQIILE..PFLWKKRE...SSETHNAYTEESVGEFFQ
13 YP_572852PPO[Chromo    RRRYIA.FHGRPVALPTHVLKAPANPLIGLRGSWSVLRE..PF.........RAGPPR..DEESLADFVV
14 YP_006766810PPO[Lep    KNRYVV.KAGHLYPVPLSPWAFFRTPLLSWRGRRDILSE...W.........KVPPRTGGPEETLSHFVR
15 XP_002984571[Selagi    KKRYIV.RNASPTMLPSNPLGFITTGLFSAQAKLKLLTE..PFSW.......KRTKAESNEDESVGAFME
16 XP_002978633[Selagi    KKRYIV.RNASPTMLPSNPLGFITTGLFSAQAKLKLLTE..PFSW.......KRTKAESNEDESVGAFME
17 NP_196926PPO-likepr    KKRYIV.RNGVPVMLPTNPIELVTSSVLSTQSKFQILLE..PFLWKKK....SSKVSDASAEESVSEFFQ
18 YP_004749312PPO(X)a    RRRFVLNRRGHPVAL..GPDVLFSSSLLSLSARLRLLSE..PW.........RPRRPQSQNDESIADFVR
19 XP_002873656_HEMG2_    KKRYIV.RNGLPMMLPTNPIELVTSSVLSTQAKIQILLE..PFLWKKNDS..SSKVSDASAEESVSGFFQ
20 NP_001236376_PPOX[G    HKRYIV.KNGAPLLVPTNPAALLKSKLLSAQSKIHLIFE..PFMWKRSD...PSNVCDENSVESVGRFFE
21 YP_002568450PPO[Chl    KRRFIL.INGTPVEIPTSPVGLITTRLLSWRGKLRVLAE..PF.........INRGST.DPDESVAAFFT
22 XP_003622202PPO[Med    HKRYIV.KNGTPVLVPANPAALLKSKLLSAQSKIQVIFE..PFMWKRSD...SSAVRDENSEESVSRFFE
23 YP_002464647PPO[Chl    RRRYIL.INGTPIEIPSSPVGLITTRLLSWRGKLRVLGE..PF.........VNIGTP.TGEESVAAFFS
24 XP_002263321_PPO_mi    NKRYIV.RNGMPVLLPSNPIALIKSNILSAKSKFQIILE..PFLWKKSD...LSKVSDDHMKESVGGFFQ
25 NP_001105004_PPOX(m    HKRYIV.KDGAPALIPSDPISLMKSSVLSTKSKIALFFE..PFLYKKANTRNSGKVSEEHLSESVGSFCE
26 NP_001190307_[Arabi    KKRYIV.RNGVPVMKK.............................SSKVSDASAEESVSEFFQ
27 YP_003433215PPO[Hyd    KKRYIY.RKGKLVALPLSPVEFLLSPFLSLGGKLRVLKE..PF.........VPRSPK..QEESIAEFVR
28 YP_004151624PPO[The    RKRFIY.KNGRLVRLPENPIAFLSSYLLSWKGKVRVLGE..LL.........VPPSEK.E.DETLAEFVR
29 YP_005845210PPO[Ign    NKRYIL.RNNELHALPMSPPALIKTKLFSAKAKLRLLTE..PF.........IGRSED.GYYQSLAEFVR
30 XP_002446710_06g020    HKRYIV.KDGAPALIPSDPISLMKSSVLSTKSKIALFFE..PFLYKKANTRNPGKVSDEHLSESVGSFFE
31 YP_004281001PPO[Des    RKRFIY.TNGRLVRLPESPIAFLASYLLSWKGKLRLVGE...F.........LVPPKKEDIDESLSEFAK
32 YP_004784657PPO[Aci    KRRYILNRHRQPVAL..GPGVLFGGGLLSWRGRLRLLGE..PF.........RSPRRMQDSEESVADFVR
33 YP_003474039PPO[The    SVRYIY.KRGKLIPLPNSPVKFLTSPLLSLGGKLRVLME..PF.........VAPSVK..TEETVAQFVR
34 YP_002796374PPO[Lar    RHRFVL.RGDRYEALPSGPLSFLTGSQFGARSKWLALTE..PF..........RRNRPVREPETVAAFFR
35 YP_002219182PPO[Aci    GRRYVLNRHRQPVAL..GPGVLFGGGLLSIRGRLRLLGE..PF.........QPPHPTPDGEESIADFVR
36 YP_003496573PPO[Def    KKRYIM.RGGVLHKLPEKPNEFFSSKLLSFKGKLRVISE..LF.........IPAKKD.EYDETIEEFAY
37 YP_001228933PPO[Geo    RKRFIY.SGGVLNRLPENGPSFLKSRLISWPGKLRLALEPTPF.........IAKAPE.GVDETLAAFGR
38 YP_002248561PPO[The    KIRYIL.IDGKLIRVPENPIKFFLTPLLSFSGKIRMLRE..YF.........TPPLKE.EIDETVESFVS
   Consensus                RYI    G   LP  P       L S   K      E  PF                    ES    F
```

Figure 1a continued

```
SEQ ID NO:                           220       230       240       250       260       270       280
 1 88809979[Amaranthus  RHFGKEFVDYVIDPFVAGTCGGDPQSLSMHHTFPEVWNIEKRFGSVFAGLIQST....LLSKKEKGGEN.
 2 PPO[Salinibacter_ru  RRLGPEVLNYAVAPFVGGVFAGDPDDLSVQHAFRRLAALEESGSLLLGAIRRA....LTSDDGAPPDT.
 3 PPO[Rhodothermus_ma  RRLGPEVLDYLVEPFVAGIFAGDPEQLSVRYAFPKLFELQQYGSLFWGLIRDR....M..KQRYHPAP.
 4 PPO[Salinibacter_ru  RRLGPEVLNYAVAPFVGGVFAGDPDDLSVQHAFRRLAALEESGSLLLGAIRRA....LTSDDGAPPDT.
 5 PPO[Rhodothermus_ma  RRLGPEVLDYLVEPFVAGIFAGDPEQLSVRYAFPKLFELQQYGSLFWGLIRDR....M..KQRYHPAP.
 6 PPO[Halothio_bacill  RRLGQGFLDWAVDPFVAGVYAGDPNRLSVQAAIPKIYAFEQESGSLIRGGIAKM....KAAKANPAPVT.
 7 YP_003547456PPO[Cor  RRLGKELYDYAINPLVGGIYAGDPEMLSLRYGFPKLYALEQEHGGLIRGALAKM....KAAKANKGPKA.
 8 YP_863962PPO[Magnet  RRLGQEFLDYAIEPFVSGVYAGDPKQLSVRAAVAKIYALEAKYGSLIKGAIALG....K..IRKAAGMP.
 9 YP_001819575PPO[Opi  SHFGREFVDYALNPFVGGVFAGDPEKLSARQSFPKLWEIEQTHGSLIRGQIAAA....K..ARKARGEP.
10 YP_006526861PPO[Mel  RRLGNEFLDYAIDPFVSGVFAGDPEKLSVKSAFPKLYRLEEVYGGLIKGMIKGA....RERKQRNEESK.
11 XP_001760919[Physco  RHFGREVVDYLVDPFIAGTSGSDPDSVSIRHTFPDLFAIEERYGSLLIGGVKSS....FKKKSGSKKESF
12 XP_002509548_amineo  RHFGKEVVDYLIDPFVAGTSAGDPESLSVCHSFPELWNLEKRFGSIIAGVVQAK....LSTKRGKSQETK
13 YP_572852PPO[Chromo  RRLGRHVLDHLVDPFVSGVYAGDPARLSAQAAMPRLVALEREYGSLVRGGLRRL....RQSRREPPALP.
14 YP_006766810PPO[Lep  RRLGEEALDYFVDPFVKGVYASHPDLLSVEAAFPLLVRLEREHGGLLRGALKTF....LKRRKRPSGSS.
15 XP_002984571[Selagi  RHFGDEIVDYAVDPFVAGTSGSDPSSISIRHSFPELWSLEKNYGSLFVGAIKSG....FSKKKKQKLRPV
16 XP_002978633[Selagi  RHFGDEIVDYAVDPFVAGTSGSDPSSISIRHSFPELWSLEKNYGSLFVGAIKSG....FSKKKKQKLRPV
17 NP_196926PPO-likepr  RHFGQEVVDYLIDPFVGGTSAADPDSLSMKHSFPDLWNVEKSFGSIIVGAIRTK....FAAKGGKSRDTK
18 YP_004749312PPO(X)a  RRLGPEALTWMVDPFVSGVFAGDPEKLSVTAALPRLAAMEAESGSLLRAALRRR....RAGKKEG.....
19 XP_002873656_HEMG2_  RHFGQEVVDYLIDPFVGGTSAADPDSLSMKHSFPDLWNVEKSFGSIIVGAIRTK....LAAKGGKSGEAK
20 NP_001236376_PPOX[G  RHFGKEVVDYLIDPFVGGTSAGDPESLSMRHSFPELWNLEKRFGSIIAGALQSK....LFAKREKTGENR
21 YP_002568450PPO[Chl  RRIGAEATAHLLDPFVAGVYAGDPQRLSTAAVFPSLWEAAQRSGSIVRGMLSKP....K..PKTQVSEP.
22 XP_003622202PPO[Med  RHFGHEVVDYLIDPFVGGTSAGDPESLSIRHSFPELWNLEKRFGSIIAGALQSS....VFGKKDKAGETK
23 YP_002464647PPO[Chl  RRIGHEAVAHLLDPFVAGVYAGDPNQLSAAAVFPSLWEAVQRGGSIVRGMLRRP....K..QKTLISEP.
24 XP_002263321_PPO_mi  RHFGKEVVDYLIDPFVAGTSGGDPESLSMHHTFPELWNLEKRFGSIIAGAVLSK....LSAKREKRGETK
25 NP_001105004_PPOX(m  RHFGREVVDYFVDPFVAGTSAGDPESLSIRHAFPALWNLERKYGSVIVGAILSK....LAAKGDPVKTRH
26 NP_001190307_[Arabi  RHFGQEVVDYLIDPFVGGTSAADPDSLSMKHSFPDLWNVEKSFGSIIVGAIRTK....FAAKGGKSRDTK
27 YP_003433215PPO[Hyd  RRFGREFLDYVVAPFVSGVFAGDPEELSVKYAVRKVYELEQKYGSVIKGAIKLK..........ALGP.
28 YP_004151624PPO[The  RRLGKEALDYLLDPMVAGIFAGDPERMSLKAAFPTIYRLEREYGGLIRGLIAKA....KEAKKKGAKSS.
29 YP_005845210PPO[Ign  RRLGQEFLDYAINPFVAGVYAGKPEELSVKSAFPKLYALEKKFGGLIIGTIRSI....RERKKRAEKSK.
30 XP_002446710_06g020  RHFGREVVDYLIDPFVAGTSAGDPESLSICHAFPALWNLERKYGSVVVGAILSK....LTAKGDPVKTRR
31 YP_004281001PPO[Des  RRIGEEALEKLLDPMVAGIFAGDPDRLSLKAAFPAIYYLEKQYGGLIKGLIAKMKEAKKSGKKSGPAGP.
32 YP_004784657PPO[Aci  RRLGEEALTWLVDPFISGVFAGNPARLSVQATLPRLIALEQDGGSLLRGALRAR......NKKSPDTP.
33 YP_003474039PPO[The  RRLGEEFLHYVITPFVRGVYAGDPEELSIKYAFRRVYQLEREYGSLIRAAIKLK..........RLGP.
34 YP_002796374PPO[Lar  RRLGDEFVERAISPFVGGIFAGDPEELVAGLTLPVIHEAERQSGSIVRGMFARR....KTFR........
35 YP_002219182PPO[Aci  RRLGDEALTWLVDPFVSGVFAGDPARLSVQATLPRLAALEQDGGSLLRGALRAR......KKKLPGTP.
36 YP_003496573PPO[Def  RRLGKEAAEYLISPMVSGVFAGDPSKLSLKSCFPVIYNLEKEYGGLFKAMFKKK.......GKKSGPAGP.
37 YP_001228933PPO[Geo  RRLGKEALRKLIAPMVSGIFAGDPETMSLVSCFPRIAELEREYGGLVKAMVKLA....KKKKQEIAEGKQ
38 YP_002248561PPO[The  RRVGKEFYEKLIDAMSTGIYAGDPSKMSMKSCFPKVYWLEKRHGGLLKGLIALK.....KEKKDTKAQP.
   Consensus            R  G E  DY   DPFV G   AGDP   LS     FP L   LE   GS   G               K

SEQ ID NO:                           290       300       310       320       330       340       350
 1 88809979[Amaranthus  .........ASIKKPRVRGSFSFQGGMQTLVDTMCKQL...GEDELKLQCEVLSLSYNQKGIPSLGNWSV
 2 PPO[Salinibacter_ru  ................PSGLFVSFRNGLQTLPNALADTL....GDRIRLNAPVHALTHDG......TAWRV
 3 PPO[Rhodothermus_ma  ................RRSMFVSFVEGLHMLPRALAERL....PAHAIVRNAEVLAIRWDEK.....NPWTL
 4 PPO[Salinibacter_ru  ................PSGLFVSFRNGLQTLPNALADTL....GDRIRLNAPVHALAHDG......TAWRV
 5 PPO[Rhodothermus_ma  ................RRSMFVSFVEGLHMLPRALADRL....PAHAIVRNAEVLAIRWDEK.....NPWTL
 6 PPO[Halothio_bacill  .............LPAKGKLFLSFKRGLQTLTDALATAITSSGRGNIQLDSAITNIQRLPE.....GGWSV
 7 YP_003547456PPO[Cor  ................KKYILVSFKDGLQTLPQSIANNL....NEPVQTGVSIESIRQIE......DMWAV
 8 YP_863962PPO[Magnet  ................RGRMISFETGMETLPATIANRL....PHQSIHTNAQVTALCQHG......AAWQV
 9 YP_001819575PPO[Opi  ................RPGIFLSFKHGLHVLPEALAARL....PAGAITLGASLDAIVPG......DKWNV
10 YP_006526861PPO[Mel  ...............QSAKMFLSFLEGMQSLPNAIADKL....KDNIVFSAKVLNVTGAND.....KQWKV
11 XP_001760919[Physco  KVQSDSAKVTPAQKR.PRGSFLSFVGGMQTLAHALASERL...DEESLELNSSVLNLASDQQGNPSRNNWTV
12 XP_002509548_amineo  G........SSVKKKQQRGSFSFFGGMQTLTDTLCKAL...AKDELRLESKVFSLSYNPDSKSAVENWSL
13 YP_572852PPO[Chromo  .............REWRGQLVLSFPAGLQRLAERLAEDIADQPGASVQCGCEVVAVGREA......DGWQV
14 YP_006766810PPO[Lep  ................PRGIFLSFAGGMTDLVEAMGKRL....GEDVGTNVDVIKYTRLE......EGFRV
15 XP_002984571[Selagi  EFEDEDSDFPARTRPRRGGSFLSFVGGMQTLANELVSRI...GKEKFKLNTFVTGLACNQQGNPSRQSWTV
16 XP_002978633[Selagi  EFEDEDSDFPARTRPRRGGSFLSFVGGMQTLANELVSRI...GKEKFKLNTFVTGLACNQQGNPSRQSWTV
17 NP_196926PPO-likepr  S........SPGTKKGSRGSFSFKGGMQILPDTLCKSL...SHDEINLDSKVLSLSYNSGSRQ...ENWSL
18 YP_004749312PPO(X)a  ................SSRLVLSFRGGLQELPRALAARL...PPDRLALSRPLTHLQRRG.......ELWHL
19 XP_002873656_HEMG2_  S........SPGTKRGSRRSFSFKGGMQILPDMLCKSL...SHDEINLDSKVLSLSYNSGSRQ...ENWSL
20 NP_001236376_PPOX[G  T........ALRKNKKRGSFSFQGGMQTLTDTLCKEL...GKDDLKLNEKVLTLAYGHDGSSSSQNWSI
21 YP_002568450PPO[Chl  ..............KMRSRTFTSFRGGLAEWPRALAQAL...GAGNVWTERRVVKLQPRD......SWWEV
22 XP_003622202PPO[Med  D........VPRKNKHQRGSFSFQGGMQTLTDTLCKEL...GKDDIKLNAKVLTLAYSHDGSSPSQNWSI
23 YP_002464647PPO[Chl  ..............KMRSRTFTSFQGGLADWPRAIARAL...GTGNVWTGRRAVGLRDLG......TYWEV
24 XP_002263321_PPO_mi  G........SSEKKKRQRGSFSFQGGMQTLTDTLCKEL...GKDKLRLKSKVLSLSYSHGEKSALENWSV
25 NP_001105004_PPOX(m  D........SSGKRRNRRVSFSFHGGMQSLINALHNEV...GDDNVKLGTEVLSLACTFDGVPALGRWSI
26 NP_001190307_[Arabi  S........SPGTKKGSRGSFSFKGGMQILPDTLCKSL...SHDEINLDSKVLSLSYNSGSRQ...ENWSL
27 YP_003433215PPO[Hyd  ................SGKLILSFEGGNATLIRKLSESL......EVHKENVELRIRRKD......DIFIL
28 YP_004151624PPO[The  ...........GPAGPGGVLTLSVKGMSQFTQLLAQEL....GESFTPEAQVKTLEKKK......DKWLV
29 YP_005845210PPO[Ign  ................QSARMLLSFKSGMISLPKAIANYF....ADKLILSAEVISVDKTA......EGFIV
30 XP_002446710_06g020  D........SSAKRRNRRVSFSFHGGMQSLINALHNEV...GDDNVKLGTEVLSLACTLDGAPAPGGWSI
31 YP_004281001PPO[Des  ................GGVLTLSKKGVKDLIDSLSEFL....GDSIETEVEILGLDRIE......KGWKV
32 YP_004784657PPO[Aci  ................KTRLILSFREGLQTLPLRVASAL....GDALRCNTPVEQLGNSD......GSWQV
33 YP_003474039PPO[The  ................PGKIILSFEGGNQSIIQQLASYV......DLETENVALRIRRKD......DRYIL
34 YP_002796374PPO[Lar  ................RKATFTLNEGLQQLPETLAQGL......DVRLDTSVQAERLE......TGWRV
35 YP_002219182PPO[Aci  ................KTRLVLSFREGLQVLPLRVANTL....GDTLRCDTPVDQLAYSG......DMWQV
36 YP_003496573PPO[Def  ................GGNLTLSYKGGLIKGINALTEQL...SNTKIYLGEEVTGLDKTN......GSFKV
37 YP_001228933PPO[Geo  .........VASAAGPGGVLTLSRDGIQTLTDILNERL...GKDMLVIGAEVTGVSRGNS.....TPYRV
38 YP_002248561PPO[The  ................SGVLMLSKKGMSELIQSLERHL....SSRILKGKKVLSIDRKN......TYYTV
   Consensus                                SF  G Q L   L   L                 V L                W V
```

Figure 1a continued

```
SEQ ID NO:                                  360       370       380       390       400       410       420
 1 88809979[Amaranthus   SSMSN.....NTS....EDQSYDAVVVTAPIRNVKEMKIMKFGNPFSLDFIPEVTYVPLSVMITAFKKDK
 2 PPO[Salinibacter_ru   TVSPPD....APA....HTRSFDALVCTVPLHRLAAM...EIDTPVDLAPLGEVTYPPLSVLALGYERDA
 3 PPO[Rhodothermus_ma   TFRQH.....GRA....STRFFDIIVCAVPLHRLAQL...RIHPPVDRRPLSTVEHPPIALVALGFRREQ
 4 PPO[Salinibacter_ru   TVSPPD....APA....HTRSFDALVCTVPLHRLAAM...EIDTPVDLAPLGEVTYPPLSVLALGYGRDA
 5 PPO[Rhodothermus_ma   TFRQH.....GRA....STRFFDIIVCAVPLHRLAQL...RIHPPVDRRPLSTVEHPPIALVALGFRREQ
 6 PPO[Halothic_bacill   KT........VQG....KTFHTRQLILSTPAHVSAQL.LGEVDGPLA.ETLAAIEYPPVTSVVMGFDRSE
 7 YP_003547456PPO[Cor   RWNG............QVKAFKELIVTVPAHKLPGL...PFEEPIR...LPAIDYPPVSVISLGYPLSA
 8 YP_863962PPO[Magnet   SWQQG.....GQHGGEPHSIIASQVVLATPASVSAQL.LRPLSPQAA.DLLESIRYAPVDSVALGYAKQD
 9 YP_001819575PPO[Opi   VWHDD.....VAT....HTQSFDSVVVALPAPALARLQIGTLGEKPL.AALALIEHPPVSSLFLGFRREQ
10 YP_006526861PPO[Mel   TYELN.....GNR....ESITADTVISTLPAYIAAGV.FGELDQKLA.ERLNSIYYPPVMVLYLGYNKKD
11 XP_001760919[Physco   TYKKEN....SQQ....KEKHFDAVILTTPLHNLQELGIEKNGIPYALDFIPEIVYQPMSVIVTAFKESD
12 XP_002509548_amineo   SYAFK.....GAKHL..QNSSYDAIVMTAPLCNVKEMKITKNRNIFSLNFLPEVSYMPLSVVITTFKKDN
13 YP_572852PPO[Chromo   ET........AAG....QRIRTRELVLAVPAPTAAAL.LAPLDAALA.APLEEIAYPPVNAVSVGFRRAD
14 YP_006766810PPO[Lep   ALMYD.....ETE....YYMTSRRLILATSAPQAAELLEGDPDGPSS..ELKSIPYAPVTIAYAGFLREQ
15 XP_002984571[Selagi   TGLETSGKR.SKR....SDKTFDAVIMTAPVDDVRTMKVVKDGKPYALDYLPTVIYEPMSVLITMFNKDS
16 XP_002978633[Selagi   TGLETSGKR.SKR....SDKTFDAVIMTAPVDDVRAMKVVKDGKPYALDYLPTVIYEPMSVLITMFNKDS
17 NP_196926PPO-likepr   SCVSHNE...TQR....QNPHYDAVIMTAPLCNVKEMKVMKGGQPFQLNFLPEINYMPLSVLITTFTKEK
18 YP_004749312PPO(X)a   Q.........TPA....GDLECRRLVLALPAAESARL.LRAEAPELA.AELEAIVYPAVATVALGFPREA
19 XP_002873656_HEMG2_   SCVSHNE...TQR....QNLHYDAVVMTAPLCNVKEMKVTKGGQPFLLNFLPEINYMPLSVLITTFTKEK
20 NP_001236376_PPOX[G   TSA.......SNQ....STQDVDAVIMTAPLYNVKDIKITKRGTPFPLNFLPEVSYVPISVMITTFKKEN
21 YP_002568450PPO[Chl   TIDGV.....NGP....ETLISRSLIIATPAFTAADL.IESVDQRAA.GALRGIPYAPVAYVHLGFRRDQ
22 XP_003622202PPO[Med   TCT.......SNR....KAQDVDAVIMTAPLGNVRDIQIKKKGNPFPLNFLPEVTYLPLSVLITTFKKEN
23 YP_002464647PPO[Chl   TVDGT.....GRL....ETITTRSVIIATPAYVAAEL.VEALDPAAA.SALRSIPYAPVSYVHLGFRRDQ
24 XP_002263321_PPO_mi   AYASNPG...KQS....KDLSFDAVIMTAPLCNVREMKIMKKGNPFLLDFLPEVSYLPLSVIITTFKKEN
25 NP_001105004_PPOX(m   SVDSKDSGDKDLA....SNQTFDAVIMTAPLSNVRRMKFTKGGAPVVLDFLPKMDYLPLSLMVTAFKKDD
26 NP_001190307_[Arabi   SCVSHNE...TQR....QNPHYDAVIMTAPLCNVKEMKVMKGGQPFQLNFLPEINYMPLSVLITTFTKEK
27 YP_003433215PPO[Hyd   D.........TKE....GKVTAKAVVVSTPATSTGYL.LRDLSWSIS.EEFDKIYYAPVLVVHVAVKFGV
28 YP_004151624PPO[The   TYTLR.....GKE....KSEEFDAVVLSLPAYAAAQV.LKETSRELS.ELLASIEYSPISVVALGFEKRG
29 YP_005845210PPO[Ign   SYRHS.....GID....EAIVCDAVLSTVPSYVAGNL.FSKFDKKFK.VHSDEIYYPPVLVYFLAYEKKN
30 XP_002446710_06g020   SDDSKDASGKDLA....KNQTFDAVIMTAPLSNVQRMKFTKGGAPFVLDFLPKVDYLPLSLMVTAFKKED
31 YP_004281001PPO[Des   KYKKE.....NEV....FEETFDAIVFSTPAYITAKL.LNDLNLELS.KLLSEIEYSPISVVALGFEKKG
32 YP_004784657PPO[Aci   S.........SGS....QTWQSKRLILALPAGAAARL.LAPTDAALA.HELDAIPYPAVGSLSIGFQRMQ
33 YP_003474039PPO[The   D.........TKE....GKYEARCVVVASPATSAGYL.LRDISWSAA.QELDKIYYAPVVYVHVATSQNI
34 YP_002796374PPO[Lar   R.........TPA....GELDADEVVLAVPADVAGQL.LASHFPAIA.ANLANVTYAPVAYLHTAWPRST
35 YP_002219182PPO[Aci   G.........SGN....QTWQSKRLVLALPAGAAARL.LAQTDATLA.RELDAIPYPAVGSLSIGFRRPQ
36 YP_003496573PPO[Def   K.........TTN....SCDNYDIVIITSPAYVAAEF.IKGLSVELS.DKLLKLNYAPMYVIGFGFKEED
37 YP_001228933PPO[Geo   Q.........TGG....RELDADIVVLATPAYATAQA.LEGIDGGMS.ATLNQIPYATMTVVCFGYEQEK
38 YP_002248561PPO[The   HL........DDG....NFIEAEKVILACPAHESAEI.LKELSSELS.DILKTIPYPPLSVVAFGFKKEQ
   Consensus                              D       P                       L    Y P  V    F
```

```
SEQ ID NO:                        430       440       450       460       470       480       490
 1 88809979[Amaranthus   VKRPLEEGFGVLIPSKEQH.NGLKTLGTLFSSMMFPDRAPSDMCLFTTKVGGSRNRKLANASTDELKQIVS
 2 PPO[Salinibacter_ru   IDHALDGFGMLVPPVEDT...LDVLGTIFSSTLFPGRAPEGHVLLTTKVGGARAPHHATSDAAALQARVA
 3 PPO[Rhodothermus_ma   VAHPLDGFGMLVPAVERD...FQILGTLFSSSLFPDRAPEGHVLLTTFVGGMRHPELALLPEDRLEALVL
 4 PPO[Salinibacter_ru   IDHALDGFGMLVPPVEDT...LDVLGTIFSSTLFPGRAPEGHVLLTTFVGGARAPHHATSDAAALQARVA
 5 PPO[Rhodothermus_ma   VAHPLDGFGMLVPAVERD...FQILGTLFSSSLFPDRAPEGHVLLTTFVGGMRHPELALLPEDRLEALVL
 6 PPO[Halothic_bacill   VAHPLDGFGLLLLPSKEKK....RTLGVLFSSTLFPDRTPAGKVLLSAFIGGRKHPEAAQGDDQELLDRVL
 7 YP_003547456PPO[Cor   IKQPLDGFGALVPEREDR....NILGVLFPSAVFDGRAPEGHGLLTVFVGGSRSPECSSPDTDQLLKTIQ
 8 YP_863962PPO[Magnet   INHSLDGFGFLIPRKEQV....TTLGGLFSTTLFPGRAPQDKALLTCFIGGMTNPSITQWSEEKVVTQVD
 9 YP_001819575PPO[Opi   VAHPLDGFGVLVPAVEKR....SVLGVLFSSSLFPGRAPLGHVALTVMVGGTRQPQLASLPADQLLAAVR
10 YP_006526861PPO[Mel   IKRKLDGFGFLIPSKEKK....HFLGAIWSSSIFPGRSPEDMAAFTLFVGGARSPQLFEMEKSDLIKKVL
11 XP_001760919[Physco   VKNSLKGFGVLVPRMEKK.NGFFTLGTMFSSSMFPDRAPPGQVVFTTFVGGSRNRALASAPFEEVKAVAL
12 XP_002509548_amineo   VKSPLEGFGVLVPSKEQQ.NGLKTLGTLFSSMMFPDRAPNDLYLYTTFVGGSRNKELAKASTDDLKQIVT
13 YP_572852PPO[Chromo   VDHPLDGFGMLIPGVERR....RTLGALFSSTLFPGRAPSDHVLLTAFLGGRRQPEAAAGDDAEQVAQVV
14 YP_006766810PPO[Lep   VTHPLDGFGLLCPTVENR....KVLGVIFSSSLFPGRAPEGKVLLTVFVGGMTGQKLAQAFDEDLERIVL
15 XP_002984571[Selagi   VKRALPGFGVLVPSKEQQANGFQTLGTLFSSFMFPDRAPEDQLLFTTFIGGSRNTLLASRSKEELLDVTL
16 XP_002978633[Selagi   VKRALPGFGVLVPSKEQQANGFQTLGTLFSSFMFPDRAPEDQLLFTTFIGGSRNTLLASRSKEELLDITL
17 NP_196926PPO-likepr   VKRPLEGFGVLIPSKEQK.HGFKTLGTLFSSMMFPDRSPSDVHLYTTFIGGSRNQELAKASTDELKQVVT
18 YP_004749312PPO(X)a   VDHRLDGFGLLIPRRLGI....ETLGVLFSSTLFPERAPPGMVLLTAFLGGAQQ.DISGRSPAELEAQAL
19 XP_002873656_HEMG2_   VKRPLEGFGVLIPSKEKK.HGFKTLGTLFSSMMFPDRCPSDLHLYTTFIGGSRNQELAKASTDELKQVVT
20 NP_001236376_PPOX[G   VKRPLEGFGVLVPSKEQK.NGLKTLGTLFSSMMFPDRAPSDLYLYTTFIGGTQNRELAQASTDELRKIVT
21 YP_002568450PPO[Chl   ISQELSGFGVLAPSSEQR....QFLGILWTSSILPHVAPHDHVLTTTLSGGAIRPELAERSDETLIEAAI
22 XP_003622202PPO[Med   VKRPLEGFGVLVPSKEQQ.NGFKTLGTLFSSMMFPDRAPSDMHLYTTFIGGTRNRELAQASTDELTKIVT
23 YP_002464647PPO[Chl   LSHELNGFGVLAPSSERR....QFLGILWASSLFPHVAPPDRVLTITLSGGAIRPEVAEQSEEALIESAI
24 XP_002263321_PPO_mi   VKRPLEGFGVLVPSKEQQ.NGLKTLGTLFSSMMFPDRAPNDLYLYTTFIGGSRNRELAKASTDELKQIVT
25 NP_001105004_PPOX(m   VKKPLEGFGVLIPYKEQQKHGLKTLGTLFSSMMFPDRAPDDQYLYTTFVGGSHNRDLAGAPTSILKQLVT
26 NP_001190307_[Arabi   VKRPLEGFGVLIPSKEQK.HGFKTLGTLFSSMMFPDRSPSDVHLYTTFIGGSRNQELAKASTDELKQVVT
27 YP_003433215PPO[Hyd   LPE...GFGFLVPKKENK....RILGVIFSSNLFEGRSPEGKSLITVYIGGATDPEIIEYEDEAIVSVLE
28 YP_004151624PPO[The   LGHNLDGFGFLVPKVEGR....KILGALWDSSVFPNRAPEGKALIRVMIGGARQPELALKSEEELTEIAL
29 YP_005845210PPO[Ign   IGQTLDGFGFLIPEKENK....SFLGALWSSVIFPYRADNNFATFTLFIGGSRYPDFVKEDRNKLLEKVR
30 XP_002446710_06g020   VKKPLEGFGVLIPYKEQQKHGLKTLGTLFSSMMFPDRAPDDQYLYTTFVGGSHNRDLAGAPTSILKQLVT
31 YP_004281001PPO[Des   LGHDLDGFGFLVPRSEKR....KILGALWDSSVFPNRAPSGKALIRVMIGGARQPELALLPDEELVNIAL
32 YP_004784657PPO[Aci   VQHPLDGFGILIPRVMGL....ETLGILFSSTLFPGRAPADQVLLTAFIGGSQN.DISGRDDDDLLATAL
33 YP_003474039PPO[The   PD....GFGFLAPQKEDL....RILGVLFSSRIFPNKAPQGKELLTIYMGGATDPEVVEYEDELIMRIVE
34 YP_002796374PPO[Lar   VGHDLDGFGGLNPKVEKP....FAAGSIWSGSLFPDRTPAGETLLTTFVGGMQFLDRYRHDDATLVALAL
35 YP_002219182PPO[Aci   VEHPLDGFGMLIPRVMGL....ETLGVLFSSTLFPGRAPAGQVLLTAFIGGSQN.VLAGRDDDDLLATVL
36 YP_003496573PPO[Def   VLDPLDGFGFLVPHNENR....KILGALFTSSIFPERAPKGYKLIRVMIGGDKNRWVLNCSEDELRDIAF
37 YP_001228933PPO[Geo   VAHDLNGFGYLIPKAEGM....NILGTLWDSSIFENRAPEGKVLLRSMMGGACFPEYIRLSDAEVVQKVR
38 YP_002248561PPO[The   IGFGTSLYGFLIPYRKQR....KILGTLFDSSIFPNRAPESYVLLRSMIGGRRAPELAMLPDEKLIDTAL
   Consensus             V   L GFG L P   E        LG LFSS   FP RAP    L T F GG       A      L
```

Figure 1a continued

```
SEQ ID NO:                                 500       510       520       530       540       550       560
 1 88809979[Amaranthus     SDLQQLLGTEDEPSFVNHLFWSNAFPLYGHNYDSVLRAIDKMEKDLPGFFYAGNHKGGLSVGKAMASGCK
 2 PPO[Salinibacter_ru     RDLDSLLGVDASPVFRRLVHWPHAIPQYELGYGTVKDTFDALEAAHPHLAFAGNYRAGVSVGDALTSGLE
 3 PPO[Rhodothermus_ma     QDLRRLLGISGAPVFRHVWRWERSIPQYRLGYDAVLACVHDVEMSRSGLFLAGNYMEGISVIDALHTGLK
 4 PPO[Salinibacter_ru     RDLDSLLGVDASPVFRRLVHWPHAIPQYELGYGTVKDTFDALEAAHPHLAFAGNYRAGVSVGDALTSGLE
 5 PPO[Rhodothermus_ma     QDLRRLLGISGAPVFRHVWRWERSIPQYRLGYDAVLACVHDVEMSRSGLFLAGNYMEGISVIDALHTGLK
 6 PPO[Halothio_bacill     GDLSPLLGIKGKPEFLRVKRWQQAIPQYEIGYLELQEKISQRLTALPGLSLNGNWRGGIAVGDCLNNGNK
 7 YP_003547456PPO[Cor     PDLETLLGIQDEPSFVHHKHWPMAIPQYTLGYEKVLEAITRIEQQYIGLKLAGNYRTGISLSYCLESAIA
 8 YP_863962PPO[Magnet     QDMMAALGIQHGAEYVHLTRYTHAIAQYEQGHLQRVGDIDRALAGYKGLHLRAGWRDGVSVSDCVLNGEK
 9 YP_001819575PPO[Opi     PDLTQLLGVSGDPVFVRHNFWPRAIPQYNLGHEHFIAALAAGERFHPGLFMGGQARDGIAVPACIAAGEK
10 YP_006526861PPO[Mel     SEFHQIMNIKGEPVLIENKLWQKAIPQYNLGYIEHEKYFEVFEENHRGIYLRGNYRGGISVGDCIKNSEL
11 XP_001760919[Physco     EDLRKIVGVQGPPVAVKHIFWKQAFPQYSLDYNEFLSSLEKMESDLPGLFYAGNHRGGLSVGKSVASGCK
12 XP_002509548_amineo     SDLRQLLGAEGEPTFVNHFYWSKAFPLYGRNYDAVLEAIDTMEKDLPGFFYAGNHKGGLSVGKAIASGCK
13 YP_572852PPO[Chromo     ADLGDLLGIHAEPVWQCVSRWPQAIPQYERGHLARIAALDAALEAHPGLSLLGNWRDGIAVGDCLENGRR
14 YP_006766810PPO[Lep     KELTELLGVKGAPSFFRIHRWEKAIPQLILGHRETVRTIRK..KLPSGLRLAGNYLDGISIARAFASGVR
15 XP_002984571[Selagi     KDLSRLIGVEGQPTAMRHVYWEKAFPRYSIGYDNVLNSIQKLESDLPGLFYAGNHRGGLAVGKTIVSGLD
16 XP_002978633[Selagi     KDLSRLIGVEGQPTAIRHVYWEKAFPRYSIGYDNVLHSIQKLESDLPGLFYAGNHRGGLAVGKTIVSGLD
17 NP_196926PPO-likepr     SDLQRLLGVEGEPVSVNHYYWRKAFPLYDSSYDSVMEAIDKMENDLPGFFYAGNHRGGLSVGKSIASGCK
18 YP_004749312PPO(X)a     ADLRPILGIRGDPAYHRCALWPRAIPQYALGHRQRVERIHELRRQLAGLELLGNWQGGVALGDCVVQA.D
19 XP_002873656_HEMG2_     SDLQRLLGVEGEPVSVNHYYWRKAFPLYDSSYGSVMEAIDKMEKDLPGFFYAGNHRGGLSIGKSIASGCK
20 NP_001236376_PPOX[G     SDLRKLLGAEGEPTFVNHFYWSKGFPLYGRNYGSVLQAIDKIEKDLPGFFFAGNYKGGLSVGKAIASGCK
21 YP_002568450PPO[Chl     RDHHQLLGIRGQPIFTHVTRWRTAIAQYTFGHRERIATLVQLEQRLPTIQFAGSYRDGVGVPKTWASGVQ
22 XP_003622202PPO[Med     SDLRKLLGAEGEPAFVNHFFWSKGFPLYGHNYGSVLEAIDKMEKDLPGFFYAGNHRGGLSVGRAIASGCK
23 YP_002464647PPO[Chl     RDNQEVLGIRGQPLLTHVTRWHHAIAQYTLGHRERIATLERLEQRRPTLQLTGSYRGGIGIPKTWASGVG
24 XP_002263321_PPO_mi     SDLRQLLGAEGEPTFVNHFYWSKAFPLFGHNYDSVLEAIDKMEKDLPGFFYAGNHKGGLSVGKAIASGCK
25 NP_001105004_PPOX(m     SDLKKLLGVEGQPTFVKHVYWGNAFPLYGHDYSSVLEAIEKMEKNLPGFFYAGNSKDGLAVGSVIASGSK
26 NP_001190307_[Arabi     SDLQRLLGVEGEPVSVNHYYWRKAFPLYDSSYDSVMEAIDKMENDLPGFFYAGNHRGGLSVGKSIASGCK
27 YP_003433215PPO[Hyd     RELRETVDIR.DWDLLKITRWKKGIPQYTVGYGRYLELANSIEMEQPGLFLSGNYLYGVSVADCIRVSHH
28 YP_004151624PPO[The     KELKRIMKIRHYPEMVKVFRHEKGIPHYTIGHAEKVERIFKLGRELGNLFFCNNAYKGVGINDCTKSARE
29 YP_005845210PPO[Ign     KEFEQLMKIKSDPVFSAYRFWEKAIPQYNIGYIEHERFFDEFEKQNPGLFISGNFRGGISVGDCIKNAEL
30 XP_002446710_06g020     SDLKKLLGVQGQPTFVKHIYWGNAFPLYGHDYNSVLEAIEKMEKNLPGFFYAGNNKDGLAVGSVIASGSK
31 YP_004281001PPO[Des     KELRRIMKIRHYPEKIKVFKHEKGIPHYTVGHAERVEKIFRLISKYPGLYLCNNAYTGVGVNDCTKAAEE
32 YP_004784657PPO[Aci     REICPLLGISGKPVFSRCQTWPKAIPQYEIGHLDRIKRIDALSARHPGLYFRAGWREGVALGDCMEEAYR
33 YP_003474039PPO[The     EDLRKSLGLT.QLEFLLVTRWKRAIPQYTLGYGRYIELVEALQRENPGLFITGNYLEGVSVADCIKRSKR
34 YP_002796374PPO[Lar     EELRRLYRIQGEPTLCRLTRQEQAIPQYDSHALPLASAVSDLHEH..GIRVCAGWHGGVSVVDCLDKGQQ
35 YP_002219182PPO[Aci     REIGPLLGISGDPVFSRCRVWPKAIPQYEIGHLDRMKRIDTLSAGHPGLHFRAGWQGGVALGDCIEQAWE
36 YP_003496573PPO[Def     NEIKDILGVKGNSVVEKSFYWERAIPQYYQGHEKLVEDIESICMDINNIYIGGNLLYGIGINDCTKRSID
37 YP_001228933PPO[Geo     DNLKTIMGIKEAPEFVRIFRHEKAIPQYTVGHGRRLAALEEQAKSHPGLFLSGNSYRGIGLNDCVAAANR
38 YP_002248561PPO[The     SELKPLLNIKGDPEFIKIFRWEKAIPQYELGHEDKLNRIEQILSEFSGLYLTGNAYRGVSVNDCIENSLK
   Consensus                DL  LLG  G P        W  AIP Y  G                PG    GN  G V       G
```

```
SEQ ID NO:                                 570       580
 1 88809979[Amaranthus     AAELVISYLDSHIYVKMDEKTA......
 2 PPO[Salinibacter_ru     AADRLLETDERATQPH............
 3 PPO[Rhodothermus_ma     AARAIIQHLREEAAGGLAKLVLGD....
 4 PPO[Salinibacter_ru     AADRLLETDERAAQPH............
 5 PPO[Rhodothermus_ma     AARAIIQHLREEAAGGLAKLVLGD....
 6 PPO[Halothio_bacill     LAERLIENTRTEES..............
 7 YP_003547456PPO[Cor     STN.........................
 8 YP_863962PPO[Magnet     SAQKILAGVS..................
 9 YP_001819575PPO[Opi     LAERAGQ.....................
10 YP_006526861PPO[Mel     EIK.........................
11 XP_001760919[Physco     AAEHVLSMLEGTGGRKIFTMASTK....
12 XP_002509548_amineo     AADLVISYLESSSDDKMLKEGPSN....
13 YP_572852PPO[Chromo     LGERLAETPDRR................
14 YP_006766810PPO[Lep     AAEELLSEDGGTPG..............
15 XP_002984571[Selagi     AAEQVLQYLQGSGGKKVFTMAS......
16 XP_002978633[Selagi     AAEQVLQYLQGSGGKKVFTMASLEQPVS
17 NP_196926PPO-likepr     AADLVISYLESCSNDKKPNDSL......
18 YP_004749312PPO(X)a     AFQRTFAQVDTATGPS............
19 XP_002873656_HEMG2_     AADLVISYLESCSNDKKPDESL......
20 NP_001236376_PPOX[G     AADLVISYLNSASDNTVPDK........
21 YP_002568450PPO[Chl     AGERIAAALAAHGTTAVSTETASG....
22 XP_003622202PPO[Med     AADLVISYLNNASDNSV...........
23 YP_002464647PPO[Chl     AGERIAAALDAQGTTADTLEQARG....
24 XP_002263321_PPO_mi     AADLVISYLNSSSDGKMFKE........
25 NP_001105004_PPOX(m     AADLAISYLESHTKHNNSH.........
26 NP_001190307_[Arabi     AADLVISYLESCSNDKKPNDSL......
27 YP_003433215PPO[Hyd     IAKRVIDFLEVKGRTVV...........
28 YP_004151624PPO[The     TAEEVLNSLC..................
29 YP_005845210PPO[Ign     VANKICVQFTMHNVQ.............
30 XP_002446710_06g020     AADLAISYLESHTKHNNLH.........
31 YP_004281001PPO[Des     VARRILDG....................
32 YP_004784657PPO[Aci     FSQDVGWQR...................
33 YP_003474039PPO[The     VVQEVVKFFR..................
34 YP_002796374PPO[Lar     VAVQCLLDYPPAS...............
35 YP_002219182PPO[Aci     FSQTADWQH...................
36 YP_003496573PPO[Def     IARGVLGG....................
37 YP_001228933PPO[Geo     TADEVVAFLQSR................
38 YP_002248561PPO[The     LAEGIMV.....................
   Consensus                A
```

Figure 1a continued non conserved
≥ 50% conserved
all match

Figure 1b

```
SEQ ID NO:                                        10        20        30        40        50        60        70
  1 88809979[Amaranthus   .....MVIQSITHLSPNLALPSPLSVSTKNYPVAVMGNISER...EEPTS...AKRVAVVGAGVSGLAAA
  2 PPO[Salinibacter_ru   .....................................................MPNVGIIGAGISGLAAA
  3 PPO[Rhodothermus_ma   .....................................................MASVGIIGAGIAGLTAA
 39 NP_951074PPO[Geobac   .....................................................MKKAIVAGGGISGLATA
 40 YP_006889062PPO[Geo   .....................................................MKKAIVAGGGISGLATA
 41 NP_214383PPO[Aquife   ...................................................MDMREVVVIGAGISGLSTA
 42 YP_006716472PPO[Pel   ......................................................MNISVVGAGISGLATA
 43 YP_006722497PPO[Geo   .....................................................MKKVIVVGGGISGLATA
 44 YP_678185PPO[Cytoph   .......................................................MIAIIGAGISGLTLA
 45 YP_002539155PPO[Geo   .....................................................MKKAIIVGGGITGLATA
 46 NP_906211PPO[Porphy   ....................................................MDHLTVIIGAGLTGLTTA
 47 YP_005367195PPO[Cor   ......................................................MTVAVIGGGITGLALA
 48 YP_004050820PPO[Cal   ......................................................MRVAIIGGGISGISTA
 49 YP_004509986PPO[Por   ....................................................MDHLTVIIGAGLTGLTTA
 50 YP_003951559PPO[Sti   .....................................................MAVIAVVGGGITGLALA
 51 YP_001928320PPO[Por   ....................................................MDHLTVIIGAGLTGLTTA
 52 YP_005468670PPO[Lep   ................................................MSTVFRCDVLIVGGGISGLAAA
 53 YP_003390864PPO[Spi   ......................................................MTIGIIGAGISGLTLA
 54 YP_003207907_PPO[Ca   ..........................................MATEQHSG...SRRIVVVGSGIAGLAAA
 55 YP_899713PPO[Peloba   .....................................................MKRAIIVGGGISGLATA
 56 214383PPO[Aquifex_a   ...................................................MDMREVVVIGAGISGLSTA
 57 003207907_PPOX[Cand   ..........................................MATEQHSG...SRRIVVVGSGIAGLAAA
 58 SPTREMBLH5S9D0_9BAC   ....................................................MGVEVAIIGAGISGLSVA
 59 SPTREMBLB6APB6_9BAC   .................................................MAGFDCDTLVVGGGVSGLAAA
 60 SPTREMBLJ3SAI0_AMBA   .................................................................GCAAA
 61 SPTREMBLA7LIU6_AMAH   .....MVIQSITHLSPKLALPSPLSVSTKNYPVAVMGNISER...EEPTS...AKRVAVVGAGVSGLAAA
 62 SPTREMBLG5DW06_SILL   ...........................................TSDPDKLQSSAKRVAVIGAGVSGLAAA
 63 SPTREMBLG5DW07_SILL   ...........................................TSDPDKLQSSAKRVAVIGAGVSGLAAA
 64 SPTREMBLK4BDT2_SOLL   ......................................MAPSAGEDKQ......KRVAVIGAGVSGLAAA
 65 SPTREMBLC6HX77_9BAC   .................................................MATEDVETLVIGGGIAGLACA
 66 SPTREMBLB4F9N9_MAIZ   .......MLALTASASSASSHPYRHASAHTRRPRLRAVLAMAGSDDPRA.APARSVAVVGAGVSGLAAA
 67 SPTREMBLI1PMI3_ORYG   .........................................MAASDDPRG...GRSVAVVGAGVSGLAAA
 68 SPTREMBLK3Y6C6_SETI   .......MLSSSTTTASPASSHPYRPAYP...RASLRPVLAMAGSDDPRA.APARSVAVIGAGVSGLAAA
 69 SPTREMBLI1IZ42_BRAD   .........................................MAASDDPRA.APARSVAVVGAGVSGLVAA
 70 SPTREMBLJ3LZ44_ORYB   MLSPAATTTTTTSYCSYSSRAHAPTRSASAGAARFRPARAMATSDNDPRGAAPARSVAVVGAGVSGLAAA
 71 SPTREMBLB8LQQ3_PICS   .......................................MAEHIHTDQNDKRPLKSVAVVGAGISGLAAA
 72 SPTREMBLQ7X7T4_ORYS   .........................................MAASDDPRG...GRSVAVVGAGVSGLAAA
 73 SPTREMBLQ8L152_PORG   ....................................................MDHLTVIIGAGLTGLTTA
 74 ORYSJ_EEE612361       .........................................MAASDDPRG...GRSVAVVGAGVSGLAAA
315 ORYSIS                .........................................MAASDDPRG...GRSVAVVGAGVSGLAAA
316 PPOCM_SPIOL_PPO       .....MVILPVSQLSTNLGL..SLVSPTKNNP..VMGNVSERNQVNQPIS...AKRVAVVGAGVSGLAAA
317 PPOM_TOBAC_EC=1334A   ......................................MAPSAGEDKHSS...AKRVAVIGAGVSGLAAA
318 PPOX_MYXXA_PPO_EC=1   .............................................MHHMPRTTGMNVAVVSGGISGLAVA
319 PDB_PPO               ......................................MAPSAGEDKHSS...AKRVAVIGAGVSGLAAA
320 PDB2_PPO_MYXOCOCCUS   ......................................MDHHHHHHHHMPRTTGMNVAVVSGGISGLAVA
    Consensus                                                                     V V GAG SGLA A
```

[Sequence alignment figure showing multiple PPO protein sequences aligned from approximately position 80 to 140, with SEQ ID NOs listed on the left side including entries 1-3, 39-74, 315-320, and a consensus sequence at the bottom reading: Y L  G    V VEA R GG IRT    G  E GPNT  S    L  LGL]

Figure 1b continued

| SEQ ID NO: | | 150 160 170 180 190 200 210 |
|---|---|---|
| 1 | 88809979[Amaranthus | REKQQLPISQNK.RYIARDGLPVLLPSN........PAALLTSNILSAKSKLQIMLE..PFLWRKHN... |
| 2 | PPO[Salinibacter_ru | HEDRVWANDAADTRYVVRDGRPTPLPRS........VGSFLTTDLFSTRAKLRLLAE..PFIGRAAA... |
| 3 | PPO[Rhodothermus_ma | EDACIPARPVAANRFIVRGGQPIPLPRS........PRELLRTPLLSPRARLRLLAE..PFIHRAHR... |
| 39 | NP_951074PPO[Geobac | SDLLLRSNDNARKRFIYTGGALNRLPEN........GPMFLKSGLISWPGKLRLAME..PFIPKKAG... |
| 40 | YP_006889062PPO[Geo | SDLLLRSNDNARKRFIYTGGALNRLPEN........GPMFLKSGLISWPGKLRLAME..PFIPKKAG... |
| 41 | NP_214383PPO[Aquife | EPVEASPSSKYR..YIYKKGRLIPLPMS........PVEFLKTPLLSLKTKLKVLTE....IFKRGV... |
| 42 | YP_006716472PPO[Pel | AEQLLRSNDAARKRFIFSGGRLQRVPES........AADFFRSSLVSWPGKLRLAAE..LLVPRRKD... |
| 43 | YP_006722497PPO[Geo | SERLLRSNDNARKRFIYTGGVLNRLPEN........GPTFLKSSLISWPGKLRLAME..PFISKRTD... |
| 44 | YP_678185PPO[Cytoph | DKLFEPAAIINKNRFIYKDANIQQVPSG........PLSFLTGRFFSAKTKYAIFKE..LFNKSISK... |
| 45 | YP_002539155PPO[Geo | DSQLLRSNDNARKRFIYSEGFLHQLPEN........GPSFFKSKLISWPGKLRLALEPTPFIAKAPD... |
| 46 | NP_906211PPO[Porphy | EPEIATPAASNR..LIWKGNKLYPLPRN........IAEAVATPLFSLWDKWRILGE..PFRRRGGQ... |
| 47 | YP_005367195PPO[Cor | SSRIRPADVAAKNRYVFTRGALRALPTS........PPAFLKSDILPLASRLRVVGE..LFSGRNPT... |
| 48 | YP_004050820PPO[Cal | SNNLVKSNDLARKRYIMRNGILHRLPEN........PPMFFKTKLLSFSAKMRILSE..YFIQKSVL... |
| 49 | YP_004509986PPO[Por | EPEIATPAASNR..LIWKGNKLYPLPRN........IAEAVGTPLFSLWDKWRILGE..PFRRRGGQ... |
| 50 | YP_003951559PPO[Sti | EERIRMADPSAKSRSLYTRGQLRPVPAS........PPAFLKSDLLPLGTRLRVLAE..LFTGRAPP... |
| 51 | YP_001928320PPO[Por | EPEIATPAASNR..LIWKGNKLYPLPRN........IAEAVATPLFSLWDKWRILGE..PFRRRGGQ... |
| 52 | YP_005468670PPO[Lep | SEKLLKASPEAQNRYVWCQGKLIPVPLS........PSSFLTTPLFSLSEKMRVAKE..FFISPGSGLPE |
| 53 | YP_003390864PPO[Spi | TPELTFSQPVSKARFIFRDGKYRQLPSG........PPSLLFGNFFSWKTKLAILRE..RNNKTVSP... |
| 54 | YP_003207907_PPO[Ca | SEQVIGTNEAHRRTFVVRDGALHPLPEGFALMGPTKPWPFLQSGLLSWRGKARAALD..LVLPRGGP... |
| 55 | YP_899713PPO[Peloba | SSDLLRSNDNARKRFIYSDGELHRLPEG........GGTFLKSRLISWPGKLRLALEPTPFIARTPA... |
| 56 | 214383PPO[Aquifex_a | EPVEASPSSKYR..YIYKKGRLIPLPMS........PVEFLKTPLLSLKTKLKVLTE....IFKRGV... |
| 57 | 003207907_PPOX[Cand | SEQVIGTNEAHRRTFVVRDGALHPLPEGFALMGPTKPWPFLQSGLLSWRGKARAALD..LVLPRGGP... |
| 58 | SPTREMBLH5S9D0_9BAC | AGERVVASEAARNRYIVRGGELHPLPLT........PLAFLRSRLWSWKGKLRVLAE..PFHGRADR... |
| 59 | SPTREMBLB6APB6_9BAC | RARIVPASGLSKNRYVVKAGHLYPVPLS........PWAFFRTPLLSWRGRRDILSE....WKVPP.RT |
| 60 | SPTREMBLJ3SAI0_AMBA | RDKQQFPISQHK.RYIVRNGKPVLIPSN........PIALIRSSFLSTQSKVQILLE..PFLWKKTK... |
| 61 | SPTREMBLA7LIU6_AMAH | REKQQLPISQNK.RYIARDGLPVLLPSN........PAALLSSNILSAKSKLQIMLE..PFLWRKRN... |
| 62 | SPTREMBLG5DW06_SILL | RDKQQLPLSQNK.RYVVRDGLPVLLPSG........PISIFTSNFLSPKSKLRLLCE..PFSWRRRDNAK |
| 63 | SPTREMBLG5DW07_SILL | RDKQQLPLSQNK.RYVVRDGLPVLLPSG........PISIFTSNFLSAKSKLRLLCE..PFSWRRRDNAK |
| 64 | SPTREMBLK4BDT2_SOLL | REKQQFPLSQNK.RYIARNGTPTLIPSN........PFDLFKSNFLSTGSKLQMLFE..PLLWKNKKLTK |
| 65 | SPTREMBLC6HX77_9BAC | AARIQLAGRMGKKRFILKDGHPVALPMS........LSEGIFTQILSLPAKVRLLKE..PFIPPAGGVDG |
| 66 | SPTREMBLB4F9N9_MAIZ | QDKQQYPNSQHK.RYIVKDGAPALIPSD........PISLMKSSVLSTKSKIALFFE..PFLYKKANTRN |
| 67 | SPTREMBLI1PMI3_ORYG | QGKQQYPNSQHK.RYIVKDGAPTLIPSD........PIALMKSTVLSTKSKLKLFLE..PFLYEKSSRRT |
| 68 | SPTREMBLK3Y6C6_SETI | QDRQQYPNSQHK.RYIVKDGAPALIPAD........PISLMKSSVLSTKSKLALFLE..PFLYKKSNTRN |
| 69 | SPTREMBLI1IZ42_BRAD | QDKQQYPNSQHK.RYTVKDGAPTLIPSD........PIALMKSTVLSTKSKFKLFLE..PFLYEKSHTRN |
| 70 | SPTREMBLJ3LZ44_ORYB | QGKLQYPNSQHK.RYIVKDGAPTLIPSD........PIGLMKSTVLSTKSKLKLFLE..PFLYEKSSKRN |
| 71 | SPTREMBLB8LQQ3_PICS | RGKQQFPIMQSK.RYIVRDGKPQLLPSN........PVAFIGSKTLSAQAKLNIFLE..PILWKHKNSKE |
| 72 | SPTREMBLQ7X7T4_ORYS | QGKQQYPNSQHK.RYIVKDGAPTLIPSD........PIALMKSTVLSTKSKLKLFLE..PFLYEKSSRRT |
| 73 | SPTREMBLQ8L152_PORG | EPEIATPAASNR..LIWKGNKLYPLPRN........IAEAVGTPLFSLWDKWRILGE..PFRRRGGQ... |
| 74 | ORYSJ_EEE612361 | QGKQQYPNSQHK.RYIVKDGAPTLIPSD........PIALMKSTVLSTKSKLKLFLE..PFLYEKSSRRT |
| 315 | ORYSIS | QGKQQYPNSQHK.RYIVKDGAPTLIPSD........PIALMKSTVLSTKSKLKLFLE..PFLYEKSSRRT |
| 316 | PPOCM_SPIOL_PPO | REKLQLPISQNK.RYIARDGLPVLLPSN........PVALLKSNILSAKSKLQIMLE..PFLWKKHN... |
| 317 | PPOM_TOBAC_EC=1334A | REKQQFPLSQNK.RYIARNGTPVLLPSN........PIDLIKSNFLSTGSKLQMLLE..PILWKNKKLSQ |
| 318 | PPOX_MYXXA_PPO_EC=1 | EGRIRAADPAAKRRYVYTRGRLRSVPAS........PPAFLASDILPLGARLRVAGE..LFSRRAPE... |
| 319 | PDB_PPO | REKQQFPLSQNK.RYIARNGTPVLLPSN........PIDLIKSNFLSTGSKLQMLLE..PILWKNKKLSQ |
| 320 | PDB2_PPO_MYXOCOCCUS | EGRIRAADPAAKRRYVYTRGRLRSVPAS........PPAFLASDILPLGARLRVAGE..LFSRRAPE... |
| | Consensus | K RYI G LP P S LS KL E PF |

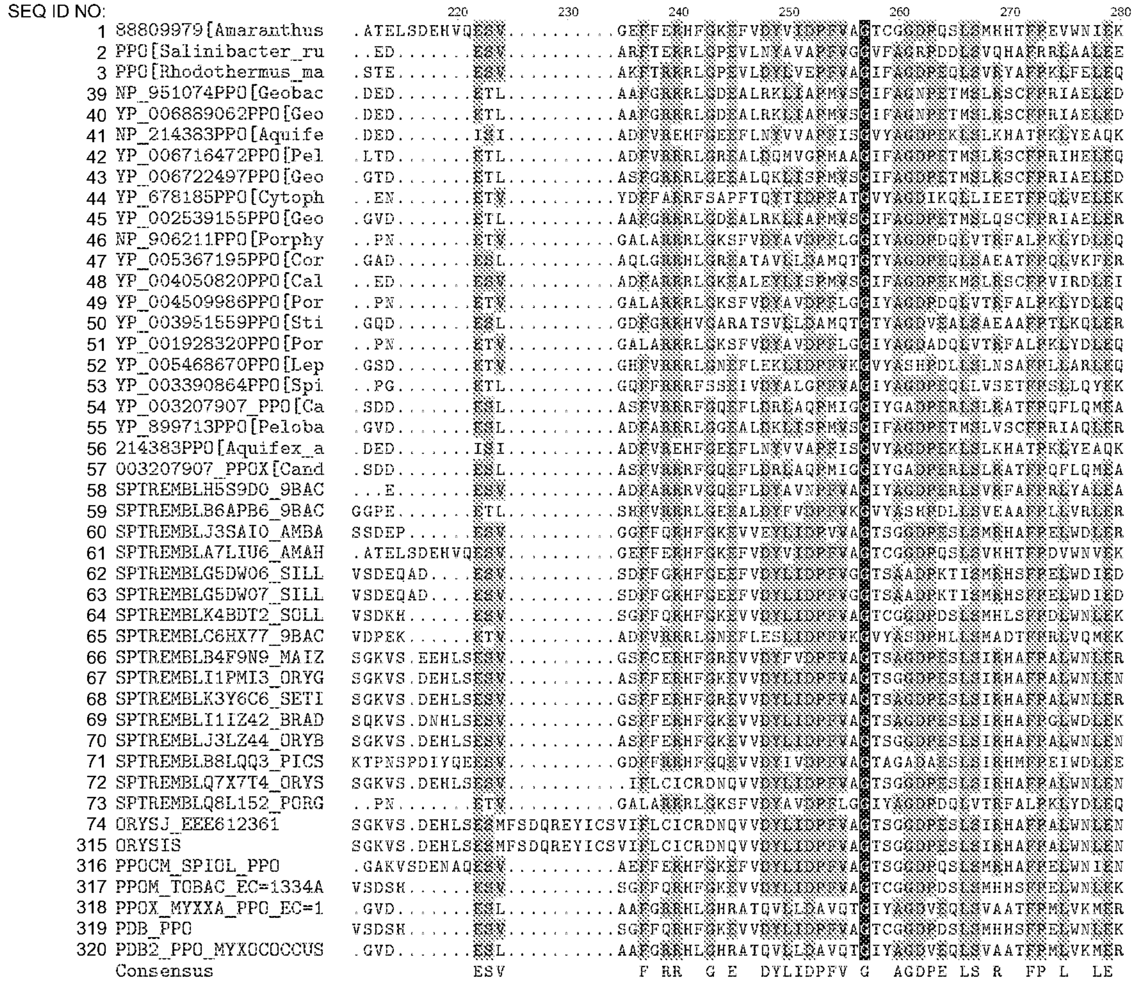

Figure 1b continued

| SEQ ID NO: | | 220 230 240 250 260 270 280 |
|---|---|---|
| 1 | 88809979[Amaranthus | .ATELSDEHVQESV.........GEEFERHFSKEFVDYVIDPFVAGTCGGDPQSLEMKHTRREVWNIEK |
| 2 | PPO[Salinibacter_ru | ..ED......ESV.........ARFTERRLSPSVLNYAVAPEYGGVFAGRPDDLEVQHAPRRLAALEE |
| 3 | PPO[Rhodothermus_ma | .STE......ESV.........AKFTRRRLSPSVLDYLVERRVAGIFAGDPEQLEVEYAPPKLFELEQ |
| 39 | NP_951074PPO[Geobac | .DED......ETL.........AAFGRRRLSDEALRKLIARMYSGIFAGNPETMSLESCPPRIAELED |
| 40 | YP_006889062PPO[Geo | .DED......ETL.........AAFGRRRLSDEALRKLIARMYSGIFAGNPETMSLESCPPRIAELED |
| 41 | NP_214383PPO[Aquife | .DED......ISI.........ADFVREHFGEEFLNYVVAPRISGVYAGDPEKLSLKHATRKYEAQK |
| 42 | YP_006716472PPO[Pel | .LTD......ETL.........ADFVRRRLSRSALSQMVGRMAAGIFAGDPETMSLESCPPRIHELEQ |
| 43 | YP_006722497PPO[Geo | .GTD......ETL.........ASFGRRRLSESALQKLISPMYSGIFAGDPETMSLESCPPRIAELED |
| 44 | YP_678185PPO[Cytoph | ..EN......ETV.........YDFFARRFSAPFTQSTIDPSATGVYAGDIKQLLIEETPPQLVELEK |
| 45 | YP_002539155PPO[Geo | .GVD......ETL.........AAFGRRRLSDEALRKLIAPMYSGIFAGDPETMSLQSCPPRIAELER |
| 46 | NP_906211PPO[Porphy | ..PN......ETY.........GALARRRLSKSFVDYAVDPRLGGIYAGDPDQLVTRFALPKLYDLEQ |
| 47 | YP_005367195PPO[Cor | .GAD......ESL.........AQLGRRHLSRSATAVELQAMQTGTYAGDPEQLSAEEATPQLVKFPR |
| 48 | YP_004050820PPO[Cal | ..ED......ESV.........ADFARRRLSKSALEYLISPMYSGIFAGDPEKMSLESCPPVIRDLEI |
| 49 | YP_004509986PPO[Por | ..PN......ETV.........GALARRRLSKSFVDYAVDPRLGGIYAGDPDQLVTRFALPKLYDLEQ |
| 50 | YP_003951559PPO[Sti | .GQD......ESL.........GDFGRRHVSARATSVELQAMQTGTYAGDVSALEAEAAPRTLKQLER |
| 51 | YP_001928320PPO[Por | ..PN......ETV.........GALARRRLSKSFVDYAVDPRLGGIYAGDADQLVTRFALPKLYDLEQ |
| 52 | YP_005468670PPO[Lep | .GSD......ETV.........GHFVRRRLSNEFLEKLIDPPYKGVYAGSHPDLSSLNSAPRLLARLEQ |
| 53 | YP_003390864PPO[Spi | ..PG......ETL.........GQRFRRRFSSEIVRYALGRRYAGIFAGDPEQLLVSETPRSSLQYEK |
| 54 | YP_003207907_PPO[Ca | .SDD......ESL.........ASFVRRRFSQEFLDRLAQPMIGGIYGADPERLSLEATPRQFLQMEA |
| 55 | YP_899713PPO[Peloba | .GVD......ESL.........ADFARRRLSGEALRKLISPMYSGIFAGDPETMSLVSCPPRIAQLER |
| 56 | 214383PPO[Aquifex_a | .DED......ISI.........ADFVREHFGEEFLNYVVAPRISGVYAGDPEKLSLKHATRKYEAQK |
| 57 | 003207907_PPOX[Cand | .SDD......ESL.........ASFVRRRFSQEFLDRLAQPMIGGIYGADPERLSLEATPRQFLQMEA |
| 58 | SPTREMBLH5S9D0_9BAC | ...E......ESV.........ADFARRRVSQEFLDYAVNPRYAGIYAGDPERLSVRFAPPRLYALEA |
| 59 | SPTREMBLB6APB6_9BAC | GGPE......ETL.........SRFVRRRLSESALDEFVDPRYKGVYAGSHRDLSVEAARPLVRELER |
| 60 | SPTREMBLJ3SAI0_AMBA | SSDEP......ESV.........GGFFQRHFSKEVVELIDPVYASTSGGDPRSLEMHAPPELWDLER |
| 61 | SPTREMBLA7LIU6_AMAH | .ATELSDEHVQESV.........GEFFERHFSKEFVDYVIDPFVAGTCGGDPQSLEMHAPRELWDVEK |
| 62 | SPTREMBLG5DW06_SILL | VSDEQAD....ESV.........SDFGRHFGESFVDYLIDPEYGGTSAGDPKTISMEHSPPELWDIED |
| 63 | SPTREMBLG5DW07_SILL | VSDEQAD....ESV.........SDFGRHFGESFVDYLIDPEYGGTSAGDPKTISMEHSPPELWDIED |
| 64 | SPTREMBLK4BDT2_SOLL | VSDKH......ESV.........SGFFQRHFGKEVVQELIDPEYAGTCGGDPDSLEMHLSPPDLWNLEK |
| 65 | SPTREMBLC6HX77_9BAC | VDPEK......ETY.........ADFVRRRLSNEFLESLIDPPYKGVYAGSHRLLSMADTPPRLVQMEK |
| 66 | SPTREMBLB4F9N9_MAIZ | SGKVS.EEHLSESV.........GSFCERHFGREVVRYFVDPRYATSGGDPRSLEIKHAPRALWNLER |
| 67 | SPTREMBLI1PMI3_ORYG | SGKVS.DEHLSESV.........ASFFERHFGKEVVRELIDPRYATSGGDPESLEIKHAPPALWNLEN |
| 68 | SPTREMBLK3Y6C6_SETI | SGKVS.DEHLSESV.........GSFFERHFGRVVRELIDPRYAGTSGGDPESLEIKHAPPALWNLER |
| 69 | SPTREMBLI1IZ42_BRAD | SQKVS.DNHLSESV.........GSFFERHFGKEVVDYLIDPRYATSAGDPESLEIKHAPPGLWDLEK |
| 70 | SPTREMBLJ3LZ44_ORYB | SGKVS.DEHLSESV.........ASFFERHFGKEVVDELIDPRYAGTSGGDPESLEIKHAPPALWNLEN |
| 71 | SPTREMBLB8LQQ3_PICS | KTPNSPDIYQEESV.........GDFFRRHFGQEVVDYIVDPRVAGTAGAGAESLEIKHMPPEIWDLEE |
| 72 | SPTREMBLQ7X7T4_ORYS | SGKVS.DEHLSESV.........IRLCICRDNQVVDELIDPRYAGTSGGDPESLEIKHAPPALWNLEN |
| 73 | SPTREMBLQ8L152_PORG | ..PN......ETV.........GALARRRLSKSFVDYAVDPRLGGIYAGDPDQLVTRFALPKLYDLEQ |
| 74 | ORYSJ_EEE612361 | SGKVS.DEHLSESVMFSDQREYICSVIFLCICRDNQVVDELIDPRYAGTSGGDPESLEIKHAPPALWNLEN |
| 315 | ORYSIS | SGKVS.DEHLSEEMFSDQREYICSVIFLCICRDNQVVDELIDPRYAGTSGGDPESLEIKHAPPALWNLEN |
| 316 | PPOCM_SPIOL_PPO | .GAKVSDENAQEEV.........AEFFERHFSKEFVDYLIDPFVAGTCGGDPQSLEMHAPRELWNLEN |
| 317 | PPOM_TOBAC_EC=1334A | VSDSK......ESV.........SGFFQRHFGKEVVRELIDPRYAGTCGGDPDSLEMHHSPPELWNLEK |
| 318 | PPOX_MYXXA_PPO_EC=1 | .GVD......ESL.........AAFGRRHLGHRATQVELDAVQTGIYAGDVEQLSVAATRMLVKMER |
| 319 | PDB_PPO | VSDSK......ESV.........SGFFQRHFGKEVVRELIDPRYAGTCGGDPDSLEMHHSPPELWNLEK |
| 320 | PDB2_PPO_MYXOCOCCUS | .GVD......ESL.........AAFGRRHLGHRATQVELRAVQTGIYAGSVEQLSVAATRMLVKMER |
| | Consensus | ESV F RR G E DYLIDPFV G AGDPE LS R FP L LE |

Figure 1b continued

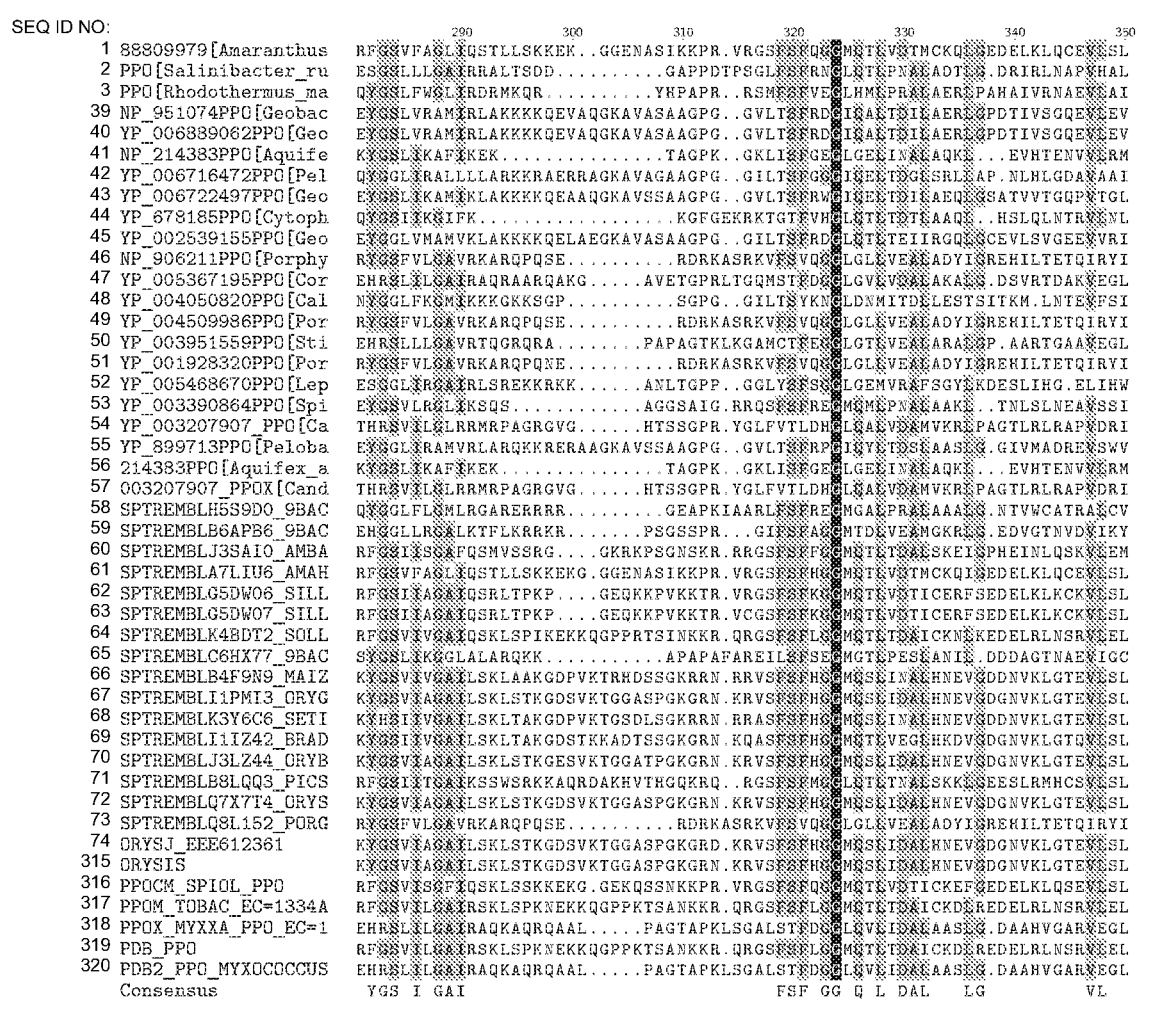

| SEQ ID NO: | | 290 300 310 320 330 340 350 |
|---|---|---|
| 1 | 88809979[Amaranthus | RFGSVFAGLIQSTLLSKKEK..GGENASIKKPR.VRGSFSFQGGMQTLVDTMCKQLGEDELKLQCEVLSL |
| 2 | PPO[Salinibacter_ru | ESGGLLLGAIRRALTSDD.........GAPPDTPSGLFSFRNGLQTLPNALADTLG.DRIRLNAPVHAL |
| 3 | PPO[Rhodothermus_ma | QYGSLFWGLIRDRMKQR.........YHPAPR..RSMFSFVEGLHMLPRALAERLPAHAIVRNAEVLAI |
| 39 | NP_951074PPO[Geobac | EYGSLVRAMIRLAKKKKQEVAQGKAVASAAGPG..GVLTSFRDGIQALTDILAERLGPDTIVSGQEVLEV |
| 40 | YP_006889062PPO[Geo | EYGSLVRAMIRLAKKKKQEVAQGKAVASAAGPG..GVLTSFRDGIQALTDILAERLGPDTIVSGQEVLEV |
| 41 | NP_214383PPO[Aquife | KYGSLIKAFIKEK..............TAGPK..GKLISFGEGLGELINALAQKL...EVHTENVVLRM |
| 42 | YP_006716472PPO[Pel | QYGGLIRALLLLARKKRAERRAGKAVAGAAGPG..GILTSFGGGIQELTDGLSRLLAP.NLHLGDAVAAI |
| 43 | YP_006722497PPO[Geo | EYGSLIKAMIKLAKKKKQEAAQGKAVSSAAGPG..GVLTSFRWGIQELTDILAEQLGSATVVTGQPVTGL |
| 44 | YP_678185PPO[Cytoph | QYGSIIKGIFK................KGFGEKRKTGTFVHGLQTLTDTLAAQL..HSLQLNTRVLNL |
| 45 | YP_002539155PPO[Geo | EYGGLVMAMVKLAKKKKQELAEGKAVASAAGPG..GILTSFRDGLQTLTEIIRGQLGCEVLSVGEEVVRI |
| 46 | NP_906211PPO[Porphy | RYGSFVLGAVRKARQPQSE.........RDRKASRKVFSVQGGLGLLVEALADYIGREHILTETQIRYI |
| 47 | YP_005367195PPO[Cor | EHRSLILGAIRAQRAARQAKG....AVETGPRLTGQMSTFDGGLGVLVDALAKALG.DSVRTDAKVEGL |
| 48 | YP_004050820PPO[Cal | NYGGLFKGMIKKKGKKSGP.........SGPG..GILTSYKNGLDNMITDLLESTSITKM.LNTEVFSI |
| 49 | YP_004509986PPO[Por | RYGSFVLGAVRKARQPQSE.........RDRKASRKVFSVQGGLGLLVEALADYIGREHILTETQIRYI |
| 50 | YP_003951559PPO[Sti | EHRSLLLGAVRTQGRQRA.......PAPAGTKLKGAMCTFEGGLGTLVEALARALGP.AARTGAAVEGL |
| 51 | YP_001928320PPO[Por | RYGSFVLGAVRKARQPQNE.........RDRKASRKVFSVQGGLGLLVEALADYIGREHILTETQIRYI |
| 52 | YP_005468670PPO[Lep | ESGGLIRGAIRLSREKKRKK.....ANLTGPP..GGLYSFSGGLGEMVRAFSGYLKDESLIHG.ELIHW |
| 53 | YP_003390864PPO[Spi | EYGSVLRGLIKSQS...........AGGSAIG.RRQSFSFREGMQMLPNALAAKL..TNLSLNEAVSSI |
| 54 | YP_003207907_PPO[Ca | THRSVILGLRRMRPAGRGVG.....HTSSGPR.YGLFVTLDHGLQALVDAMVKRLPAGTLRLRAPVDRI |
| 55 | YP_899713PPO[Peloba | EYGGLIRAMVRLARQKKRERAAGKAVSSAAGPG..GVLTSFRPGIQYLTDSLAASLG.GIVMADREVSWV |
| 56 | 214383PPO[Aquifex_a | KYGSLIKAFIKEK..............TAGPK..GKLISFGEGLGELINALAQKL...EVHTENVVLRM |
| 57 | 003207907_PPOX[Cand | THRSVILGLRRMRPAGRGVG.....HTSSGPR.YGLFVTLDHGLQALVDAMVKRLPAGTLRLRAPVDRI |
| 58 | SPTREMBLH5S9D0_9BAC | QYGGLFLGMLRGARERRRR.........GEAPKIAARLFSFREGMGALPRALAAALG.NTVWCATRALCV |
| 59 | SPTREMBLB6APB6_9BAC | EHGGLLRGALKTFLKRRKR.......PSGSSPR...GIFSFAGGMTDLVEAMGKRLG.EDVGTNVDVIKY |
| 60 | SPTREMBLJ3SAI0_AMBA | RFGSIISGAFQSMVSSRG....GKRKPSGNSKR.RRGSFSFFGGMQTLTDALSKEIGPHEINLQSKVLEM |
| 61 | SPTREMBLA7LIU6_AMAH | RFGSVFAGLIQSTLLSKKEKG.GGENASIKKPR.VRGSFSFHGGMQTLVDTMCKQIGEDELKLQCEVLSL |
| 62 | SPTREMBLG5DW06_SILL | RFGSIIAGAIQSRLTPKP....GEQKKPVKKTR.VRGSFSFKGGMQTLVDTICERFSEDELKLKCKVLSL |
| 63 | SPTREMBLG5DW07_SILL | RFGSIIAGAIQSRLTPKP....GEQKKPVKKTR.VCGSFSFKGGMQTLVDTICERFSEDELKLKCKVLSL |
| 64 | SPTREMBLK4BDT2_SOLL | RFGSVIVGAIQSKLSPIKEKKQGPPRTSINKKR.QRGSFSFLGGMQTLTDAICKNLKEDELRLNSRVLEL |
| 65 | SPTREMBLC6HX77_9BAC | SYGSLIKGGLALARQKK..........APAPAFAREILSFSEGMGTLPESLANIL.DDDAGTNAEVIGC |
| 66 | SPTREMBLB4F9N9_MAIZ | KYGSVIVGAILSKLAAKGDPVKTRHDSSGKRRN.RRVSFSFHGGMQSLINALHNEVGDDNVKLGTEVLSL |
| 67 | SPTREMBLI1PMI3_ORYG | KYGSVIAGAILSKLSTKGDSVKTGGASPGKGRN.KRVSFSFHGGMQSLIDALHNEVGDGNVKLGTEVLSL |
| 68 | SPTREMBLK3Y6C6_SETI | KYHSIIVGAILSKLTAKGDPVKTGSDLSGKRRN.RRASFSFHGGMQSLINALHNEVGDDNVKLGTEVLSL |
| 69 | SPTREMBLI1IZ42_BRAD | KYGSIIVGAILSKLTAKGDSTKKADTSSGKGRN.KQASFSFHGGMQTLVEGLHKDVGDGNVKLGTQVLSL |
| 70 | SPTREMBLJ3LZ44_ORYB | KYGSVIAGAILSKLSTKGESVKTGGATPGKGRN.KRVSFSFHGGMQSLIDALHNEVGDGNVKLGTEVLSL |
| 71 | SPTREMBLB8LQQ3_PICS | RFGSIITGAIKSSWSRKKAQRDAKHVTHGQKRQ..RGSFSFMGGLQTLTNALSKKLGEESLRMHCSVLSL |
| 72 | SPTREMBLQ7X7T4_ORYS | KYGSVIAGAILSKLSTKGDSVKTGGASPGKGRN.KRVSFSFHGGMQSLIDALHNEVGDGNVKLGTEVLSL |
| 73 | SPTREMBLQ8L152_PORG | RYGSFVLGAVRKARQPQSE.........RDRKASRKVFSVQGGLGLLVEALADYIGREHILTETQIRYI |
| 74 | ORYSJ_EEE612361 | KYGSVIAGAILSKLSTKGDSVKTGGASPGKGRD.KRVSFSFHGGMQSLIDALHNEVGDGNVKLGTEVLSL |
| 315 | ORYSIS | KYGSVIAGAILSKLSTKGDSVKTGGASPGKGRN.KRVSFSFHGGMQSLIDALHNEVGDGNVKLGTEVLSL |
| 316 | PPOCM_SPIOL_PPO | RFGSVISGFIQSKLSSKKEKG.GEKQSSNKKPR.VRGSFSFQGGMQTLVDTICKEFGEDELKLQSEVLSL |
| 317 | PPOM_TOBAC_EC=1334A | RFGSVILGAIRSKLSPKNEKKQGPPKTSANKKR.QRGSFSFLGGMQTLTDAICKDLREDELRLNSRVLEL |
| 318 | PPOX_MYXXA_PPO_EC=1 | EHRSLILGAIRAQKAQRQAAL.....PAGTAPKLSGALSTFDGGLQVLIDALAASLG.DAAHVGARVEGL |
| 319 | PDB_PPO | RFGSVILGAIRSKLSPKNEKKQGPPKTSANKKR.QRGSFSFLGGMQTLTDAICKDLREDELRLNSRVLEL |
| 320 | PDB2_PPO_MYXOCOCCUS | EHRSLILGAIRAQKAQRQAAL.....PAGTAPKLSGALSTFDGGLQVLIDALAASLG.DAAHVGARVEGL |
| | Consensus | YGS I GAI FSF GG Q L DAL LG VL |

Figure 1b continued

| SEQ ID NO: | | 360 370 380 390 400 410 420 |
|---|---|---|
| 1 | 88809979[Amaranthus | SYNQKGIPSLGNWSVSSMSNNTSED.....QSYDAVVVTAPIRNVKEMKIMKFGNPFSLDFIPEVTYVPL |
| 2 | PPO[Salinibacter_ru | THDGTA......WRVTVSPPDAPAHT....RSFDALVCTVPLHRLAAM...EIDTPVDLAPLGEVTYPPL |
| 3 | PPO[Rhodothermus_ma | RWDEKN.....PWTLTFRQHGRAST.....RFFDIIVCAVPLHRLAQL...RIHPPVDRRPLSTVEHPPI |
| 39 | NP_951074PPO[Geobac | SRGGSL.....PWRVRTGSID.........MDADLVILATPAYATASI..IQGVDSDMAGILRQIPYATM |
| 40 | YP_006889062PPO[Geo | SRGGSL.....PWRVRTGSID.........MDADLVILATPAYATASI..IQGVDSDMAGILRQIPYATM |
| 41 | NP_214383PPO[Aquife | RKFEDF......FRLDVRGKK.........VETKSVVVASPAYTSSYL..LKEVSFSASEEFDKIDYPPV |
| 42 | YP_006716472PPO[Pel | TPLKEG......FSLRTHKGRV........HETDIVVAAVPAMALATQ..VEGFSAPMAAQLRQIPYAPL |
| 43 | YP_006722497PPO[Geo | TRGSSV.....PWRLKTPTVD.........IDADVVILASPAHATAGI..VSGVDAAMAQVLGEIPYASM |
| 44 | YP_678185PPO[Cytoph | RKQMDK......IVLTTDTKHGIEE.....LTFDKVVVCGTTFQAATL..IKDSYPDLSAILSQVQYASM |
| 45 | YP_002539155PPO[Geo | RKGSSV.....PYRVETTSRE.........LDADVVVLATPAYATGQM..LEGLDSAMTGILGQIPYATM |
| 46 | NP_906211PPO[Porphy | NHPGAH.....TFGLTYTDASEEEHT....IPCRHLVSTVAAHHIPTL..FDHFPADESAVFEQLYYAPM |
| 47 | YP_005367195PPO[Cor | ERAADG......WTVRYQQRGQPAE.....LSASHVVLAVPAHVAASL..VRPLDAELAQKADAIPYAPI |
| 48 | YP_004050820PPO[Cal | DKKINR......YILNTNKGI.........MEFDKIFINAPAYAVSQM..LSVLDKDLSRDLNNITYPPV |
| 49 | YP_004509986PPO[Por | NHPGAH.....TFGLTYTDASEEEHT....IPCRHLVSTVAAHHIPTL..FDHFPADESAVFEQLYYAPM |
| 50 | YP_003951559PPO[Sti | ARSQNG......WRLSVRERGQQAE.....LEASQVVLTSPAHVSAEL..LAPLDPSLAGHLKGIPYAPI |
| 51 | YP_001928320PPO[Por | NHPGAH.....TFGLTYTDASEEEHT....IPCRHLVSTVAAHHIPTL..FDRFPADESAVFEQLYYAPM |
| 52 | YP_005468670PPO[Lep | NRLPSG.....EFQCVLLQDEERVE.....VISQKMILATSPADAGRI..LEKNQPEIASVLSSIPMAPI |
| 53 | YP_003390864PPO[Spi | SPTPNG......WEVETNTGT.........TTVDKLVLAVGTDAAARL..VDQRYPDLARTLQAITYPPM |
| 54 | YP_003207907_PPO[Ca | AHTEQG......WTVRLGDGAS........LQADGLILAVPAFEIARL..THDLDQDLARQLEAMPYASS |
| 55 | YP_899713PPO[Peloba | RRGKSA.....AWRVGCRDGGE........YDADLVIVASPAHAASAI..LHDCDAGIASILESIPYASM |
| 56 | 214383PPO[Aquifex_a | RKFEDF......FRLDVRGKK.........VETKSVVVASPAYTSSYL..LKEVSFSASEEFDKIDYPPV |
| 57 | 003207907_PPOX[Cand | AHTEQG......WTVRLGDGAS........LQADGLILAVPAFEIARL..THDLDQDLARQLEAMPYASS |
| 58 | SPTREMBLH5S9D0_9BAC | ERAGAA......FEIAFERDGRRDT.....LRAERVVLATPAYAAASL..LKRLAPEAARALDRIVYPPV |
| 59 | SPTREMBLB6APB6_9BAC | TRLEEG......FRVALMYDETEYY.....MTSRRLILATSAPQAAEL..LEGDPDGPSSELKSIPYAPV |
| 60 | SPTREMBLJ3SAI0_AMBA | SYSCDD.NAVGNWSIYCAPDQNKQFQ....QSFDAVIMTAPLNNLKEMKITKTGSPFLLNFIPEVSYLPI |
| 61 | SPTREMBLA7LIU6_AMAH | SYNQKGIPSLGNWSVSSMSNNTSED.....QSYDAVVVTAPIRNVKEMKIMKFGNPFSLDFIPEVTYVPL |
| 62 | SPTREMBLG5DW06_SILL | SYSHEG..HSNNWSLSCLSNKSIED.....RPYDAVVVTAPLTNVKDMKILNGGSPFSLDFVPEVDYLPV |
| 63 | SPTREMBLG5DW07_SILL | SYSHEG..HSNNWSLSCLSNKSIED.....RPYDAVVVTAPLTNVKDMKILNGGSPFSLDFVPEVDYLPV |
| 64 | SPTREMBLK4BDT2_SOLL | SCSCSGDSAIDSWSIFSASPHKRQAE...EESFDAVIMTAPLCDVKSMKIAKRGNPFLLNFIPEVDYVPL |
| 65 | SPTREMBLC6HX77_9BAC | APSESG......FRTALLFEEETYY.....IRSKHLVLALPAAQTAEL..IEPMAPGIPSLLGQIPYAPI |
| 66 | SPTREMBLB4F9N9_MAIZ | ACTFDGVPALGRWSISVDSKDSGDKDLASNQTFDAVIMTAPLSNVRRMKFTKGGAPVVLDFLPKMDYLPL |
| 67 | SPTREMBLI1PMI3_ORYG | ACCCDGVSSSGGWSISVDSKDAKGKDLRKNQSFDAVIMTAPLSNVQRMKFTKGGVPFVLDFLPKVDYLPL |
| 68 | SPTREMBLK3Y6C6_SETI | ACTFDGLPSTGGWSISVDSKDAGSKDLAKNQTFDAVIMTAPLSNVQRMKFRKGGAPFVLDFLPKVNYLPL |
| 69 | SPTREMBLI1IZ42_BRAD | ACSCDRLSASDGWSISVNSKDASSKLAAKNQLFDAVIMTAPLSNVQRMKFTKGGVPFVLDFLPKVDYLPL |
| 70 | SPTREMBLJ3LZ44_ORYB | ACSCDEISSSGGWSIAVDSRDAKGKDLRKNQSFDAVIMTAPLSNVQRMKFTKNGAPFVLDFLPKVDYLPL |
| 71 | SPTREMBLB8LQQ3_PICS | SCNLQGNPPHNNWSVCYARNDASYKEPLKEQSFDAVVMT.........................VTYLPM |
| 72 | SPTREMBLQ7X7I4_ORYS | ACCCDGVSSSGGWSISVDSKDAKGKDLRKNQSFDAVIMTAPLSNVQRMKFTKGGVPFVLDFLPKVDYLPL |
| 73 | SPTREMBLQ8L152_PORG | NHPGAH.....TFGLTYTDASEEEHT....IPCRHLVSTVAAHHIPTL..FDRFPANESAVFEQLYYAPM |
| 74 | ORYSJ_EEE612361 | ACCCDGVSSSGGWSISVDSKDAKGKDLRKNQSFDAVIMTAPLSNVQRMKFTKGGVPFVLDFLPKVDYLPL |
| 315 | ORYSIS | ACCCDGVSSSGGWSISVDSKDAKGKDLRKNQSFDAVIMTAPLSNVQRMKFTKGGVPFVLDFLPKVDYLPL |
| 316 | PPOCM_SPIOL_PPO | SYSHNGSLTSENWSVSSMSNSTIQD.....QPYDAVVVTAPINNVKELKIMKVENPFSLDFIPEVSCLPL |
| 317 | PPOM_TOBAC_EC=1334A | SCSCTEDSAIDSWSIISASPHKRQSE...EESFDAVIMTAPLCDVKSMKIAKRGNPFLLNFIPEVDYVPL |
| 318 | PPOX_MYXXA_PPO_EC=1 | AREDGG......WRLIIEEHGRRAE.....LSVAQVVLAAPAHATAKL..LRPLDDALAALVAGIAYAPI |
| 319 | PDB_PPO | SCSCTEDSAIDSWSIISASPHKRQSE...EESFDAVIMTAPLCDVKSMKIAKRGNPFLLNFIPEVDYVPL |
| 320 | PDB2_PPO_MYXOCOCCUS | AREDGG......WRLIIEEHGRRAE.....LSVAQVVLAAPAHATAKL..LRPLDDALAALVAGIAYAPI |
| | Consensus | W D V P P L Y P |

Figure 1b continued

```
SEQ ID NO:                                   430       440       450       460       470       480       490
  1 88809979[Amaranthus       SVMITAFKKDKVKRPLEGFGVLIPSKEQH.NGLKTLGTLFSSMMFPDRAPSDMCLFTTFVGGSRNRKLAN
  2 PPO[Salinibacter_ru       SVLALGYERDAIDHALDGFGMLVPPVEDT...LDVLGTIFSSTLFPGRAPEEHVLLTTFVGGARAPHHAT
  3 PPO[Rhodothermus_ma       ALVALGFRREQVAHPLDGFGMLVPAVERD...FQILGTLFSSSLFPDRAPEEHVLLTTFVGGMRHPELAL
 39 NP_951074PPO[Geobac       TVVCFGYDRERIAHDLNGFGYLIPKEEGM....NTLGTLWDSSIFENRAPEEQVLLRSMMGGACFPEYVN
 40 YP_006889062PPO[Geo       TVVCFGYDRERIAHDLNGFGYLIPKEEGM....NTLGTLWDSSIFENRAPEEQVLLRSMMGGACFPEYVN
 41 NP_214383PPO[Aquife       VVVNVG.....VEGKFPKVRLLSSESGKK....RILGAMFMSKLFPGRAPQSKELLTVFLGGATDREVIE
 42 YP_006716472PPO[Pel       QIACFGYRREALPLSLDGFGYLAARRSGM....HSLGTLWSSSIFPGRAPAGYVLLRTMFGGATRPDALQ
 43 YP_006722497PPO[Geo       TVVCFGFERERIAYDLNGFGYLIPKDEGM....NTLGTLWDSSIFENRAPEGKVLLRSMLGGACFPEYVK
 44 YP_678185PPO[Cytoph       KAVFAAFKRTDVTHPMNGFGCLYPSAEQS....FLAGTIWNSSIFNDRCPADEVLTTSFIGGMHHPEYTA
 45 YP_002539155PPO[Geo       SVVCLGYEQDKISHDLNGFGYLIPKGEGM....NILGTLWDSSIFENRAPQGRVLLRSMMGGACFPEYIK
 46 NP_906211PPO[Porphy       IEVAVGFRR.NVATHLPAFGCLIPSRENR....RILGILFPSDCFRGRAPEGGALYSIFMGGVRNASLID
 47 YP_005367195PPO[Cor       AVVHLGFAPGTVPKP.DGFGFLVPAVEGT....AMLGTIHVSTTFPFRVEGGRVLLTCLMGGARRPEVVS
 48 YP_004050820PPO[Cal       FVAGFIFKPEDLEDPLDGFGYLIPHSENK....RILGALFDSSIFPDRTRDGYKIVRTIMGGDKNRWIIE
 49 YP_004509986PPO[Por       IEVAVGFRR.NVATHLPAFGCLIPSRENR....RILGILFPSDCFRGRAPEGGALYSIFMGGVRNASLID
 50 YP_003951559PPO[Sti       AVVHLGFAPGKTPPP.DGFGFLVPGQEQR....QLLGVIHVSTVFPFRAEGGRVLYTCLMGGARRPDLVG
 51 YP_001928320PPO[Por       IEVAVGFRR.NVATHLPAFGCLIPSRENR....RILGILFPSDCFRGRAPEGGALYSIFMGGVRNASLID
 52 YP_005468670PPO[Lep       AIAYIGVDRKALPGYLPGFGVLFPTSEKR....KILGIIQNSDLFPNRSPDGKVLLTIFAGGMLSPKIAM
 53 YP_003390864PPO[Spi       TAVHSAYKRADVRHPLNGFGGLNPAVEGR....FAAGHIWSSSIFTGRCPDDEVLFTTFVGGQTGAHNTR
 54 YP_003207907_PPO[Ca       VTINLAYRREAIHHPLDGFGFVVPACEGR....TIIACSFSSVKFAHRAPAGHVLLRAFAGGALQPEPFT
 55 YP_899713PPO[Peloba       TVVCLGYERELVSHPLDGFGYLIPKKEGR....SILGTLWDSSMFENRAPTGKVLLRSMVGGACFPDYVH
 56 214383PPO[Aquifex_a       VVVNVG.....VEGKFPKVRLLSSESGKK....RILGAMFMSKLFPGRAPQSKELLTVFLGGATDREVIE
 57 003207907_PPOX[Cand       VTINLAYRREAIHHPLDGFGFVVPACEGR....TIIACSFSSVKFAHRAPAGHVLLRAFAGGALQPEPFT
 58 SPTREMBLH5S9D0_9BAC       SAVILGYPETAIGRPLDGFGFLVPEKEQR....RILGTIWNSTIFPARAPQGFVTLTTFVGGMRQPELAR
 59 SPTREMBLB6APB6_9BAC       TIAYAGFLREQVTHPLDGFGLLCPTVENR....KVLGVIFSSSLFPGRAPEGKVLLTVFVGGMTGQKLAQ
 60 SPTREMBLJ3SAI0_AMBA       SVIISTFKKENVKQPLEGFGVLVPAKEQE.NGLRTLGTLFSSMMFPDRASEDVYLYTTFVGGSRNKELAK
 61 SPTREMBLA7LIU6_AMAH       SVMITAFKKDKVKRPLEGFGVLIPSKEQH.NGLKTLGTLFSSMMFPDRAPSDMCLFTTFVGGSRNRKLAK
 62 SPTREMBLG5DW06_SILL       SIIVTAFKKANVERPLEGFGVLIPSKEQE.KGLKTLGTLFSSMMFPDRSPADQYLYTTFVGGSRNRELAR
 63 SPTREMBLG5DW07_SILL       SIIVTAFKKANVERPLEGFGVLIPSKEQE.KGLKTLGTLFSSMMFPDRSPADQYLYTTFIGGSRNRELAR
 64 SPTREMBLK4BDT2_SOLL       SVVITTFKKESVKHPLEGFGVLVPSQEQK.HGLKTLGTLFSSMMFPDRAPNNVYLYTTFVGGSRNRELAK
 65 SPTREMBLC6HX77_9BAC       AVVYLGYPRDRISHPLDGFGLLVPSRERR....KILGALFSSSLFPGRSPDGHVLLTVFVGGMTQPKLAQ
 66 SPTREMBLB4F9N9_MAIZ       SLMVTAFKKDDVKKPLEGFGVLIPYKEQQKHGLKTLGTLFSSMMFPDRAPDDQYLYTTFVGGSHNRDLAG
 67 SPTREMBLI1PMI3_ORYG       SLMVTAFKKEDVKKPLEGFGVLIPYKEQQKHGLKTLGTLFSSMMFPDRAPNDQYLYTSFIGGSHNRDLAG
 68 SPTREMBLK3Y6C6_SETI       SLMVTAFKKEDVKKPLEGFGVLIPYKEQQKHGLKTLGTLFSSMMFPDRAPDDQYLYTTFVGGSHNRDLAG
 69 SPTREMBLI1IZ42_BRAD       SLMVTAFRKEDVKRPLEGFGVLIPYKEQQKYGLKTLGTLFSSMMFPDRAPNDQHLFTTFVGGSHNRDLAA
 70 SPTREMBLJ3LZ44_ORYB       SLMVTAFKKEDVKRPLEGFGVLIPYKEQQKHGLKTLGTLFSSMMFPNRAPNDQYLYTSFIGGSHNRDLAG
 71 SPTREMBLB8LQQ3_PICS       SIIITTFKKQDVKHPLEGFGILVPSKEEK.NGFQTLGTLFSSNMFPDRAPTDQYLFTTFIGGNRNRKLAK
 72 SPTREMBLQ7X7T4_ORYS       SLMVTAFKKEDVKKPLEGFGALIPYKEQQKHGLKTLGTLFSSMMFPDRAPNDQYLYTSFIGGSHNRDLAG
 73 SPTREMBLQ8L152_PORG       IEVAVGFRR.NVATHLPAFGCLIPSRENR....RILGILFPSDCFRGRAPEGGALYSIFMGGVRNASLID
 74 ORYSJ_EEE612361           SLMVTAFKKEDVKKPLEGFGALIPYKEQQKHGLKTLGTLFSSMMFPDRAPNDQYLYTSFIGGSHNRDLAG
315 ORYSIS                    SLMVTAFKKEDVKKPLEGFGALIPYKEQQKHGLKTLGTLFSSMMFPDRAPNDQYLYTSFIGGSHNRDLAG
316 PPOCM_SPIOL_PPO           SVIITTFKKTNVKRPLEGFGVLVPSNEQH.NGLKTLGTLFSSMMFPDRAPSDVYLYTTFVGGSRNRELAK
317 PPOM_TOBAC_EC=1334A       SVVITTFKRENVKYPLEGFGVLVPSKEQQ.HGLKTLGTLFSSMMFPDRAPNNVYLYTTFVGGSRNRELAK
318 PPOX_MYXXA_PPO_EC=1       AVVHLGFDAGTLPAP.DGFGFLVPAEEQR....RMLGAIHASTTFPFRAEGGRVLYSCMVGGARQPGLVE
319 PDB_PPO                   SVVITTFKRENVKYPLEGFGVLVPSKEQQ.HGLKTLGTLFSSMMFPDRAPNNVYLYTTFVGGSRNRELAK
320 PDB2_PPO_MYXOCOCCUS       AVVHLGFDAGTLPAP.DGFGFLVPAEEQR....RMLGAIHASTTFPFRAEGGRVLYSCMVGGARQPGLVE
    Consensus                       F    V  PL GFG L P  E        LGTLFSS  FP RAP G  L T F GG      LA
```

Figure 1b contined

```
SEQ ID NO:                                    500       510       520       530       540       550       560
  1  88809979[Amaranthus     ASTDELKQIVSSDLQQLLGT..E.DEPSFVNHLFWSNAFPLYGHNYDSVLRAIDKMEKDLPGFFYAGNHK
  2  PPO[Salinibacter_ru     SDAAALQARVARDLDSLLGV..D.ASPVFRRLVHWPHAIPQYELGYGTVKDTFDALEAAHPHLAFAGNYR
  3  PPO[Rhodothermus_ma     LPEDRLEALVLQDLRRLLGI..S.GAPVFRHVWRWERSIPQYRLGYDAVLACVHDVEMSRSGLFLAGNYM
 39  NP_951074PPO[Geobac     LTDEEVTGRVKNDLATIMGI..T.APPSFVRIFRHHQAIPQYTVGHSTRVAALEQRAASLPGLFLTGNSY
 40  YP_006889062PPO[Geo     LTDEEVTGRVKNDLATIMGI..T.APPSFVRIFRHHQAIPQYTVGHSTRVAALEQRAASLPGLFLTGNSY
 41  NP_214383PPO[Aquife     LSEEEIENIVERELKEILQI..D..CIDFMHVQKWKRAIPQYTLGYDRFLNLAQEMEKDYPGLFLTGNWL
 42  YP_006716472PPO[Pel     LSADEVQQRVEEDLSRSMGI..K.QAPDFVRIIRHTAAIPQYVSGHGARLKVLEDKAAYPGLFLVGNAF
 43  YP_006722497PPO[Geo     LSDAEVMQRVKADLKATMGI..T.ADPSFIRIFRHPQAIPQYTVGHGKRLAALQERSSALPGLFLTGNSY
 44  YP_678185PPO[Cytoph     LSESELEQRAIQQLSKDLGI..T.GKPTFTHVAGWNKAIPQYDI.YLKKARLASKLLSD.DHIYFRSNWT
 45  YP_002539155PPO[Geo     LSDEEVQRRVCDNLKTIMGI..A.APPDFVRIFRHEKAIPQYTVGHGKRLQALLDAGRNHQGLLLTGNSY
 46  NP_906211PPO[Porphy     LSDEEISTIAMEELRDMLRIPHT.CKPDLLHISRHRHAIPQYYADTELRQDIIRRMEMRWPGLHLGGNMH
 47  YP_005367195PPO[Cor     RDEDALVALAREELKAMAGL..T.ATPELTAVFRWPRGIPQYTVGHLERLAAMEERLKRWPGLHLAGNAY
 48  YP_004050820PPO[Cal     KSDDELIRMAFDDIKETLKI..K.REPYKIKYFRWEKAIPQYYIGHHKIVEKVEEFYKKFDDIFIGGNIL
 49  YP_004509986PPO[Por     LSDEEISTIAMEELRDMLHIPHT.CKPDLLHISRHRHAIPQYYADTELRQDIIRRMEMRWPGLHLGGNMH
 50  YP_003951559PPO[Sti     LNEEALAALAQQELREMAGV..T.ASPDFTEAVRWPRGIPQYTVGHLERLSAIDSALARLPGLHLAGNAY
 51  YP_001928320PPO[Por     LSDEEISTIAMEELRDMLHIPHT.CKPDLLHISRHRHAIPQYYADTELRQDIIRRMEMRWPGLHLGGNMH
 52  YP_005468670PPO[Lep     SFDEDFEQIVLGELKTVFGL..D.SRPEFFRIQRWAEGISQYSPGHASRIQRIRDLTPE..GMILTGNYL
 53  YP_003390864PPO[Spi     HPDSVLAHNVHKELVDGFGI..TAATPVYQSVFRWERAIPQYDATLASAKESVKAMEAD..QLFVCANWY
 54  YP_003207907_PPO[Ca     WDDETLLSAVRRDLEELLAI..H.APPLWSQLVRHPRVMPQYQVGHLGRLAALEETLRRWPTLKLTGNAY
 55  YP_899713PPO[Peloba     MGDDELLGRVRGDMKDVMGI..V.AEPSFIRIFRHPQAIPQYTVGHGERLKHLEERLACHPGLILTGNSY
 56  214383PPO[Aquifex_a     LSEEEIENIVERELKEILQI..D..CIDFMHVQKWKRAIPQYTLGYDRFLNLAQEMEKDYPGLFLTGNWL
 57  003207907_PPOX[Cand     WDDETLLSAVRRDLEELLAI..H.APPLWSQLVRHPRVMPQYQVGHLGRLAALEETLRRWPTLKLTGNAY
 58  SPTREMBLH5S9D0_9BAC     RPNEELIALVAEELTDLLRL..R.GEPEFAYVSRWERAIPQYELGYGEILDALDRAEREHVGLYFCANYR
 59  SPTREMBLB6APB6_9BAC     AFDEDLERIVLKELTELLGV..K.GAPSFFRIHRWEKAIPQLILGHGETVRTIRKKLPS..GLRLAGNYL
 60  SPTREMBLJ3SAI0_AMBA     ASRDELKQIVTSDLRQLLGT..E.GEPKFLTHYYWSKAFPLYGRDYGSVIEAIEKMEKELPGYFYAGNHK
 61  SPTREMBLA7LIU6_AMAH     ASTDELKQIVSSDLQQLLGT..E.DEPSFVNHLFWSNAFPLYGHNYDSVLRAIDKMEKDLPGFFYAGNHK
 62  SPTREMBLG5DW06_SILL     ATTDELKQVVLSDLQQLLGV..K.GDPSFINHVYWSKAFPRYGQNYESVKMAIAKMENDLPGFFYASNHK
 63  SPTREMBLG5DW07_SILL     ATTDELKQVVLSDLQQLLGV..K.GDPSFINHVYWSKAFPRYGQNYESVKMAIAKMENDLPGFFYASNHK
 64  SPTREMBLK4BDT2_SOLL     ASRTELKEIVTSDLKQLLGA..E.GEPTYVNHLCWSKAFPLYGHNYDSVLDAIDKMEKSLPGLKYAGNHK
 65  SPTREMBLC6HX77_9BAC     AFDEDLLPMVTKEIGSMLGV..L.GAPSYVRIQRWAGAIPQSVPGHGERIRSIESALPS..GLHLAGSYL
 66  SPTREMBLB4F9N9_MAIZ     APTSILKQLVTSDLKKLLGV..E.GQPTFVKHVYWGNAFPLYGHDYSSVLEAIEKMEKNLPGFFYAGNNK
 67  SPTREMBLI1PMI3_ORYG     APTAVLKQLVTSDLRKLLGV..E.GQPTFVKHVHWRNAFPLYGQNYDLVLEAIAKMENNLPGFFYAGNNK
 68  SPTREMBLK3Y6C6_SETI     APTSILKQLVTSDLKKLLGV..E.GQPTFVKHIYWRNAFPLYGRDYGSVLDAIEKMEKNLPGFFYAGNNK
 69  SPTREMBLI1IZ42_BRAD     APTAILKQLVTSDLRKLLGV..E.GQPTFVKHVHWKNAFPLYGHDYDLALEAIGKMENELPGFFYAGNNK
 70  SPTREMBLJ3LZ44_ORYB     ASTAILKQLVTSDLRKLLGI..E.GQPTFVKHVHWGNAFPLYGRNYDLVLEAIAKMEKNLPGFFYAGNNK
 71  SPTREMBLB8LQQ3_PICS     SQLKDLQEVAVNDLNKILGV..G.SDPLSVKHIYWNEAFPLYSLDYNSVVAAIDKLGKSLPGIYFAGNYR
 72  SPTREMBLQ7X7T4_ORYS     APTAILKQLVTSDLRKLLGV..E.GQPTFVKHVHWRNAFPLYGQNYDLVLEAIAKMENNLPGFFYAGNNK
 73  SPTREMBLQ8L152_PORG     LSDEEISTIAMEELRDMLHIPHT.CKPDLLHISRHRHAIPQYYADTELRQDIIRRMEMRWPGLHLGGNMH
 74  ORYSJ_EEE612361         APTAILKQLVTSDLRKLLGV..E.GQPTFVKHVHWRNAFPLYGQNYDLVLEAIAKMENNLPGFFYAGKSM
315  ORYSIS                  APTAILKQLVTSDLRKLLGV..E.GQPTFVKHVHWRNAFPLYGQNYDLVLEAIAKMENNLPGFFYAGKSM
316  PPOCM_SPIOL_PPO         ASTDELKQIVSSDLQQLLGT..E.GEPTFVNHFYWSKAFPLYGRNYDSVLRAIEKMERDLPGLFYAGNHK
317  PPOM_TOBAC_EC=1334A     ASRTELKEIVTSDLKQLLGA..E.GEPTYVNHLYWSKAFPLYGHNYDSVLDAIDKMEKNLPGLKYAGNHR
318  PPOX_MYXXA_PPO_EC=1     QDEDALAALAREELKALAGV..T.ARPSFTRVFRWPLGIPQYNLGHLERVAAIDAALQRLPGLHLIGNAY
319  PDB_PPO                 ASRTELKEIVTSDLKQLLGA..E.GEPTYVNHLYWSKAFPLYGHNYDSVLDAIDKMEKNLPGLKYAGNHR
320  PDB2_PPO_MYXOCOCCUS     QDEDALAALAREELKALAGV..T.ARPSFTRVFRWPLGIPQYNLGHLERVAAIDAALQRLPGLHLIGNAY
     Consensus                    L   V  DL  LLG       P F     W  AIPQY       L AI   E   PGLF  GN
```

Figure 1b continued

```
SEQ ID NO:                                    570        580        590        600
  1 88809979[Amaranthus    GGLSVGKAMASGCKAAELVI..SYLDSHIYVKMDEKTA..........
  2 PPO[Salinibacter_ru    AGVSVGDALTSGLEAADRLL...ETDER.....ATQPH..........
  3 PPO[Rhodothermus_ma    EGISVIDALHTGLKAARAII..QHLREE.....AAGGLAKLVLGD...
 39 NP_951074PPO[Geobac    RGIGLNDCVAAANRTAGEAI..AQLTSR....................
 40 YP_006889062PPO[Geo    RGIGLNDCVAAANRTAGEAI..AQVTSR....................
 41 NP_214383PPO[Aquife    YGVSTADCIRASKKVAQKVL..SFLRPQ.....A..............
 42 YP_006716472PPO[Pel    YGVGLNDCVAAADRVASRVL..TLMQQR.....QQA............
 43 YP_006722497PPO[Geo    RGIGLNDCATAANRTTDEVV..AYLKGR....................
 44 YP_678185PPO[Cytoph    NGISLGNCIQSARDLALIL.............................
 45 YP_002539155PPO[Geo    RGIGLNDCVAAAVRSSNEVM..EHLQKR....................
 46 NP_906211PPO[Porphy    GGIGMAHRISQGVEMARSIIEETAIAER.....SARG...........
 47 YP_005367195PPO[Cor    RGVGVNDCLKEAARLAEALG..GPAAGA.....TRSA...........
 48 YP_004050820PPO[Cal    YGVGINDCTRTSFMNVDRFK..NLLNK.....................
 49 YP_004509986PPO[Por    GGIGMAHRISQGVEMARSIIEETAIAER.....SARG...........
 50 YP_003951559PPO[Sti    KGVGLNDCIRNAAALAETLA..SR........................
 51 YP_001928320PPO[Por    GGIGMAHRISQGVEMARSIIEETAIAER.....SARG...........
 52 YP_005468670PPO[Lep    GGISVLKTFTNGLEAGKAFL..S.........................
 53 YP_003390864PPO[Spi    GGVSLSDCIGKSRKLADQLAVKPFIKNF....................
 54 YP_003207907_PPO[Ca    RGVGVPDVVHSGETAADSLL..AELAPS.....PTEPTPACTEGDSRL
 55 YP_899713PPO[Peloba    RGIGLNDCVAAAQRASDQAL..ELLR......................
 56 214383PPO[Aquifex_a    YGVSTADCIRASKKVAQKVL..SFLRPQ.....A..............
 57 003207907_PPOX[Cand    RGVGVPDVVHSGETAADSLL..AELAPS.....PTEPTPACTEGDSRL
 58 SPTREMBLH5S9D0_9BAC    GGIAVGDCVMSAHATAERIL..RDRARS....................
 59 SPTREMBLB6APB6_9BAC    DGISIARAFASGVRAAEELL..SEDGGT.....PG.............
 60 SPTREMBLJ3SAI0_AMBA    GGLSVGKAISSGCKAAESVI..AYLDSY.....SNQK...........
 61 SPTREMBLA7LIU6_AMAH    GGLSVGKAMASGCKAAELVI..SYLDSHLYVKMNEKTA..........
 62 SPTREMBLG5DW06_SILL    DGLSVGKALASGYKAADLVM..SYLNSY.....SNTNQ..........
 63 SPTREMBLG5DW07_SILL    DGLSVGKALASGYKAADLVM..SYLNSY.....SNTNQ..........
 64 SPTREMBLK4BDT2_SOLL    GGLSVGKALSSGCNAADLVI..SYLEAV.....SADTKNHS.......
 65 SPTREMBLC6HX77_9BAC    SGVSVSQTFSSGIRAAEKIL..AQSPG.....................
 66 SPTREMBLB4F9N9_MAIZ    DGLAVGSVIASGSKAADLAI..SYLESH.....TKHNNSH........
 67 SPTREMBLI1PMI3_ORYG    DGLAVGNVIASGSKAADLVI..SYLESC.....TDQDN..........
 68 SPTREMBLK3Y6C6_SETI    DGLAVGNVIASGSKAAELAI..SYLESQ.....TKHNNSH........
 69 SPTREMBLI1IZ42_BRAD    DGLAVGNVIASGSKTADLVI..SYLESH.....QAR............
 70 SPTREMBLJ3LZ44_ORYB    DGLAVGNVIASGSKAAELVL..SYLESH.....TDQDN..........
 71 SPTREMBLB8LQQ3_PICS    GGLSVGKALTSGFKAADLAI..SDFNSKGLCTMIGTDHEVK.......
 72 SPTREMBLQ7X7T4_ORYS    DGLAVGNVIASGSKAADLVI..SYLESC.....TDQDN..........
 73 SPTREMBLQ8L152_PORG    GGIGMAHRISQGVEMARSIIEETAIAER.....SARG...........
 74 ORYSJ_EEE612361        KAPLL..........YKRNL..RYLKHI.....PVD............
315 ORYSIS                 KAPLL..........YKRNL..RYLKHI.....PVD............
316 PPOCM_SPIOL_PPO        GGLSVGKSIASGYKAAELAI..SYLESN.....KMTEETI........
317 PPOM_TOBAC_EC=1334A    GGLSVGKALSSGCNAADLVI..SYLESV.....STDSKRHC.......
318 PPOX_MYXXA_PPO_EC=1    KGVGLNDCIRNAAQLADAL.....VAGN.....TSHAP..........
319 PDB_PPO                GGLSVGKALSSGCNAADLVI..SYLESV.....STDSKRHC.......
320 PDB2_PPO_MYXOCOCCUS    KGVGLNDCIRNAAQLADAL.....VAGN.....TSHAP..........
    Consensus               G         G   A        L
```

X non conserved

X ≥ 50% conserved

X all match

Figure 2

```
SEQ ID NO:                                    10        20        30        40        50        60        70
 1 88809979[Amaranthus       .......................................................MVIQSITHLSPNLAL
75 PPO[Salinibacter_ru       ......................................................................
76 PPO[Rhodothermus_ma       ......................................................................
77 Tcastaneum_EST|DT79       ......................................................................
78 Tcastaneum_EST|DN64       ......................................................................
79 Mycosphaerella_gram       ......................................................................
80 Mycosphaerella_gram       MSIDTEEATCQVPVELSAGSESEEELNDIAEHELEDDFDPHFHREGQATPMVDIAGPASESQHQQPPAFS
81 Mycosphaerella_gram       .....................................................MLHSRSCTYRLLAPAVA
82 Apisum_EST|CN759425       ......................................................................
83 Schizophyllum_commu       ......................................................................
   Consensus

SEQ ID NO:                                    80        90       100       110       120       130       140
 1 88809979[Amaranthus       PSPLSVSTKNYPVAVMGNISEREEPTSAKRVAVVGAGVSGLAAAYKLKSH..GL.SVTLFEADSRAG...
75 PPO[Salinibacter_ru       ...........................MPNVGIIGAGISGLAAAYRLQEH..GH.SVRVLEASGHTG...
76 PPO[Rhodothermus_ma       ...........................MASVGIIGAGIAGLTAAYELHRR..GL.EVTVFEATDRIG...
77 Tcastaneum_EST|DT79       ........NMSLRLVLFLVFCIGKVLGNFSVIVIGAGPSGIAAATKLLQH..SV.NVTVLEAENRIG...
78 Tcastaneum_EST|DN64       .............................SVIIVGAGVSGISAAVKLFEN..GIANLKIFEAEDRIG...
79 Mycosphaerella_gram       ..................MASSSSPNHGKKAIVIGAGVGGVSTAARLAAA..GF.SVTVLEKNSFTG...
80 Mycosphaerella_gram       RWVSKLRRKRHNHPQLLSPRKERWTLDDFDTRAASPGQQYLSPGRHYHSDSQGS.SVRFVTAVRSATATL
81 Mycosphaerella_gram       RRITPLVPSQCLLQTHRSRTYSAEAAPSHDVAVLSGGITGLAAAHYVTREHPRA.KVTLYEASDRVG...
82 Apisum_EST|CN759425       ................................KREGGIEK............NQ.SIQIIEASDHTG...
83 Schizophyllum_commu       .........................MAPHHIAVLSGGLTGLSSAYHLSHRFPNA.LITLVERSTRVG...
   Consensus                                                V V GAG  GL AA  L     G  SVT  EA  R G

SEQ ID NO:                                   150       160       170       180       190       200       210
 1 88809979[Amaranthus       ..GKLKTVKKD..........GFIWDEG....................ANTMTESEAEVS....SLIDDL
75 PPO[Salinibacter_ru       ..GVIRSESSE..........GFLVEHG....................PNSIRAGAAGLE....TLIDAL
76 PPO[Rhodothermus_ma       ..GFIQSERID..........GFLVELG....................PQTLQRTSGDFE....ELLRQV
77 Tcastaneum_EST|DT79       ..GRINTVKFG..........DGLVELG....................AEYCHGEVGNIVK...ELVNGY
78 Tcastaneum_EST|DN64       ..GRIHTVKFG..........DNFIDLG....................AQYCHGENVVY.....DTVKDL
79 Mycosphaerella_gram       ..GRCSLIHHD..........GYRFDQGPSLLLL..............PHLFHATFADLGTT..LEKEGV
80 Mycosphaerella_gram       ASASMATLSRRTTRFRRGHQRSSIVSGSEIRLSIESRRSIIDEAAKQRARKRREKLEELIRTEESYVADV
81 Mycosphaerella_gram       ..GWVSSKRADVHD......GTVLFEGG....................PRTLRPNGNGVLAANASQMQEL
82 Apisum_EST|CN759425       ..GWIQSWKDE........NTNVISELG....................PRTIRGRGKSANNTY.SLIKDL
83 Schizophyllum_commu       ..GWAESERVSLKDPKDGSEASILIEGG....................PRTLRPTAKSVL....ELVTRL
   Consensus                   G I S                L E G                    P T R            L   L

SEQ ID NO:                                   220       230       240       250       260       270       280
 1 88809979[Amaranthus       GLREKQQLPI...SQ..NK............................RYIARDGLPVLLRSNPA......
75 PPO[Salinibacter_ru       DLHE.DRVWA...NDAADT............................RYVVRDGRPTPLLRSVG......
76 PPO[Rhodothermus_ma       DLED.ACIPA...RPVAAN............................RFIVRGGQPIPLLRSPR......
77 Tcastaneum_EST|DT79       DLLEPNFNYL.......NG............................EIYYSNG................
78 Tcastaneum_EST|DN64       DLLEHAQLFS...TR................................KMYYSNG................
79 Mycosphaerella_gram       HLLKCEPNY......................................NIHFGDGEKFTLSTDL.......
80 Mycosphaerella_gram       KALSNAYFTILAHQPTATSFARTSTQRTIADILHLHDDILGCLHRIVPFAEYDQTIARLRLPLR..AHNR
81 Mycosphaerella_gram       DLTK.DAIFTQKSSPAAQN............................RFVVYPDHIVRMRHPSAGLFNNL
82 Apisum_EST|CN759425       GIED....LVRNVGIDASA............................RYIFANGNIHQLRMSVWKALFTV
83 Schizophyllum_commu       DLLD.DLILVPRTSPSAKN............................KYFHMPGQPGLLAVPSS.....F
   Consensus                 DLL           P A                              R     G    LP

SEQ ID NO:                                   290       300       310       320       330       340       350
 1 88809979[Amaranthus       .ALLTSNILSAKSK...LQIMLEPFLWRKHNATELSDEHVQESVGEFFERHFGKEFVDYVIDPFVAGTCG
75 PPO[Salinibacter_ru       .SFLTTDLFSTRAK...LRLLAEPFIGRAAAEDE........SVARFTERRLGPEVLNYAVAPFVGGVFA
76 PPO[Rhodothermus_ma       .ELLRTPLLSPRAR...LRLLAEPFIHRAHRSTE.......ESVAKFTRRRLGPEVLDYLVEPFVAGIFA
77 Tcastaneum_EST|DT79       .SKLDHGFVREMQD.....LILSENKEENYDTRG.......KSIGEVFMHKYNSTLVEK.........YK
78 Tcastaneum_EST|DN64       .SHLDNQLTQDLQK......VVSSYDHDITRSKE.......LSLGDAFLKKYNSTILEK.........YK
79 Mycosphaerella_gram       .SVMKEEIEKWEGKDGYDRYLA..FLRESHAHYE.......LSVTHVLLKNFTSLLSMLRISFL......
80 Mycosphaerella_gram       WHSMDAVPQRTTPNRSTLATIRQGRRSLNISRSSSDDAQVVLRCSPQTIAAVAKAFSDNMLRFAAYEDYG
81 Mycosphaerella_gram       WSLMTEPVFATALK...SGFMEAFTTGRDGSIQD.......KSIAEFFSRRLSPTMVDRILSAVIHGIYA
82 Apisum_EST|CN759425       NQPFTKPWIYYVLR...ECFSSNNSKDKLSDVQN.....NDKSAYDFFCRTFGQEFADYLISPLLCGVCG
83 Schizophyllum_commu       KGLISSPLGACLTR...AVAKEAMAFSNRDDLKD.......KSFDSFLCRRFTAEFAEKVGSALVHGIFA
   Consensus                  S L         K                   E       ES   FF R    E  D        G
```

Figure 2 continued

```
SEQ ID NO:                           360        370        380        390        400        410        420
 1 88809979[Amaranthus   ▒▒PQSL▒.....MHHT..................................................▒PE
75 PPO[Salinibacter_ru   ▒RPDDL▒.....VQH▒..................................................▒RR
76 PPO[Rhodothermus_ma   ▒▒PEQL▒.....VRY▒..................................................▒PK
77 Tcastaneum_EST|DT79   S▒ENK▒KLLKEGLHF▒..................................................ERS
78 Tcastaneum_EST|DN64   N▒PENFKLASDGLTF▒..................................................HST
79 Mycosphaerella_gram   ...QH▒V.....ALHP..................................................▒ES
80 Mycosphaerella_gram   ANYDLIQRDVDDTQR▒ISGWADFDKAIEAISAHVNPMRTREANRKRAMTVKDLLIKPIQRLPRYELL▒SD
81 Mycosphaerella_gram   ▒▒VNK▒▒.....AKSL..................................................▒PN
82 Apisum_EST|CN759425   ▒NAKQM▒.....VKFM..................................................▒GA
83 Schizophyllum_commu   A▒SRK▒▒.....VRA▒..................................................▒PV
   Consensus             GD   LS        A                                                    F

SEQ ID NO:                           430        440        450        460        470        480        490
 1 88809979[Amaranthus   VWNI▒K.RF▒▒VFA▒L▒QST.............LLSKKEKG.........GENASIKKPRVRGS▒S▒QG▒
75 PPO[Salinibacter_ru   ▒AAL▒E.ES▒▒LLL▒A▒RRA...................L.........TSDDGAPPDTPSGL▒S▒RN▒
76 PPO[Rhodothermus_ma   ▒FEL▒Q.QY▒▒LFW▒L▒RDR..............................MKQRYHPAPR.RSM▒S▒VE▒
77 Tcastaneum_EST|DT79   ILIS▒....▒▒FSWFDAS...............................ADSDWLECPGNQTLVWKGV▒
78 Tcastaneum_EST|DN64   ILMH▒....▒AFHWSRPA...............................SGRHYKAVKGDQMMVWKQR▒
79 Mycosphaerella_gram   IWS....RASRYFW...TERLRRVFTFGSMYMGMSPFDAPG.........TYSLLQYTELAEGIWYPVG▒
80 Mycosphaerella_gram   ▒HKLTPACDDPISHAE▒EELRLKLNSVCHRMNAAKENPARARALEMTWLIGDRLTFSSQVPRSI▒LQLL▒
81 Mycosphaerella_gram   QWRH▒A.KYD▒LIK▒V▒QERAEGTMVTKREADFLQAMKVFE.........WDPLLKATLKDNSV▒T▒KD▒
82 Apisum_EST|CN759425   ▒YEA▒R.KH▒TVGL▒LLKEQ.................................................
83 Schizophyllum_commu   ▒WEA▒EYGW▒▒VVR▒F▒RGR...........REEDVEESYY.........ISNPVQKAMEETAV▒S▒RN▒
   Consensus             L   E     GS   G I                                              F F  G

SEQ ID NO:                           500        510        520        530        540        550        560
 1 88809979[Amaranthus   MQT▒VDTM.......CKQ▒GED...ELK▒QCE▒LSLSYNQKGIPSLGNWSVSSM.SNNTSEDQSYDAVVV
75 PPO[Salinibacter_ru   LQT▒PNA▒.......ADT▒GD....RIR▒NAP▒HALTHDG......TAWRVT▒SPPDAPAHTRSFDALVC
76 PPO[Rhodothermus_ma   LHM▒PRA▒.......AER▒PAH...AIVRNAE▒LA▒RWDE.....KNPWTLTFR.QHGRASTRFFDIIVC
77 Tcastaneum_EST|DT79   YKTVLEI▒MKSYPNPDEK▒PLDD..KLF▒NSK▒TK▒NWGE........KPIK▒H.TSDKVYSADYVIFTP
78 Tcastaneum_EST|DN64   YDMILDV▒LKRYPDPSLKIPIEE..KLF▒NKR▒TK▒TWTG........DKAS▒KLSDGTSHEADHVIFTP
79 Mycosphaerella_gram   FHKVVGA▒VGI....AERMGA....EFR▒ETA▒KR▒CVTA.....DGARATG▒ELENGEVLEADVVVNNS
80 Mycosphaerella_gram   RVS▒CGS▒YIAYRSRDRIKGAYVICVLFESCLLLASCDED...QSKYSILVSITLANATIEETDNAKGLQ
81 Mycosphaerella_gram   LQM▒PDR▒.......KSR▒FEDGRVEFKTGSP▒ES▒VQSQ......GNSGIQ▒T.TKGSTESKTHTHVIS
82 Apisum_EST|CN759425   ..................................LSSIWNR.............................
83 Schizophyllum_commu   MDTVARAT.......EHH▒SKLKNVTILKGAD▒KSLGVNS......KDKSIE▒QIRP........THVVS
   Consensus               L   L           L         L   V  I                  V

SEQ ID NO:                           570        580        590        600        610        620        630
 1 88809979[Amaranthus   TAPIRNVKEMKIMKFGN▒FSLDF..IPE▒TY........VPLSVMITA▒KKDK...VK........RPLE
75 PPO[Salinibacter_ru   TVPLHRLAAMEI...DT▒VDLAP..LGE▒TY........PPLSVLA▒GYERDA...ID........HALD
76 PPO[Rhodothermus_ma   AVPLHRLAQLRI...HP▒VDRRP..LST▒EH........PPIALVA▒G▒RREQ...VA........HPLD
77 Tcastaneum_EST|DT79   SIGVLKAGSDLFTPSLP▒KKHKA..ID▒IGF........AGVVKLF▒R▒PVKW...WD........DNDK
78 Tcastaneum_EST|DN64   SVGVL.THDDLFEPVVP▒RKQQA..IK▒MGF........DGIIKLI▒Y▒PEKW...WH........DSDS
79 Mycosphaerella_gram   DLVYAYNHLLQPQAYAESLSDRPGSCS▒ISFYWALDRKVPELSAHNIFLADDYRESFDSIFKKHLIPDQP
80 Mycosphaerella_gram   CHTAPHAWKVVFEQGARMYELIFTACSA▒ESEVWRTHIASGIETQIAAVAEGKANVFE..LQSPLTADMK
81 Mycosphaerella_gram   ALSPEHLNTVCR...HGSASSRL..ID▒IPT........VTVMTVSMY▒RTPD...LH........EP..
82 Apisum_EST|CN759425   ....EKVKDT.....KGTNTVKP..PP▒YY........................................
83 Schizophyllum_commu   TLPLPALHRVL....TPTSNLPH..LTTNPY........STVTVYN▒I▒RTDTPTPIH........PA..
   Consensus                              P          SV                 L F

SEQ ID NO:                           640        650        660        670        680        690        700
 1 88809979[Amaranthus   ▒▒▒V▒I..▒......SKEQHNGLKT....▒▒TL▒........................S▒M......MF▒
75 PPO[Salinibacter_ru   ▒▒▒MEV..▒PVEDTLDV............▒▒TI▒........................S▒T......LF▒
76 PPO[Rhodothermus_ma   ▒▒▒MEV..▒AVERDFQI............▒▒TL▒........................S▒S......LF▒
77 Tcastaneum_EST|DT79   Y▒AFFW..SDDDLKSENFPEGPPEK....RKIVG........................YPA......VGL
78 Tcastaneum_EST|DN64   T▒FF▒WDRKDLEGITKEFNEGPSKDGISWVSNL.................................VAL
79 Mycosphaerella_gram   S▒YVNV..▒SRVDSTAAPEGKDTVVVLVPV▒HLT........................GEAAASHF.SQ▒
80 Mycosphaerella_gram   SI▒KAFGK▒GSFVRRMSVQRAATIGPTAD▒NQVIIKNTQAVKEVMDNSSQGSFQIPRSQ▒VATPSHVQTL
81 Mycosphaerella_gram   ▒▒▒Y▒I..▒QA....TPFENNPERA....▒▒VV▒........................DTA......YS▒
82 Apisum_EST|CN759425   ......................................................................
83 Schizophyllum_commu   ▒▒▒Y▒I..▒RPPGGYEQPQANKEGI....▒▒CV▒........................D▒CALSAQDVM▒
   Consensus             GFG L    P                    LG  F                         S          P

SEQ ID NO:                           710        720        730        740        750        760        770
 1 88809979[Amaranthus   DRA▒SDMCLF▒TFV▒▒S.........RNRKL.▒NAST....▒ELKQI▒SSD▒QQL..............▒
75 PPO[Salinibacter_ru   GRA▒EGHVL▒▒TFV▒▒A.........RAPHH.▒TSDA....AALQAR▒ARD▒DSL..............▒
76 PPO[Rhodothermus_ma   DRA▒EGHVL▒▒TFV▒▒M.........RHPEL.▒LLPE....▒RLEAL▒LQD▒RRL..............▒
77 Tcastaneum_EST|DT79   VPSWAQHQR▒DDLDL▒E.........MVPEI.EQLPI....ETLKKG▒NFT▒EKF..............▒
78 Tcastaneum_EST|DN64   VKV▒SNPHV▒IGWVS▒G.........LIPEM.EKMSL....▒VVKKGSMFVIRKF..............▒
79 Mycosphaerella_gram   ASS▒SKPNGG▒IKSASPSTQTGIPPTLDQDWP▒MIAL....A..RQTIIKTIHHR..............T
80 Mycosphaerella_gram   APRRADRHR▒ETILSDV.........WSRDLLPYPGMVRRS▒PIRAGANHVIRKFSMASITSNFSSSKRT
81 Mycosphaerella_gram   GSSDSRGTKV▒VML▒▒H.........WWDGWP▒FPDE....EEGVTMARAV▒ERH..............▒
82 Apisum_EST|CN759425   ............LD▒▒......................................LQR▒IHA..............
83 Schizophyllum_commu   ..G▒TKYTKM▒VMT▒▒P.........YQN...KPPAL....▒....T▒LQA▒ARH..............▒
   Consensus                P      LT    GG                   A          D      V   L                L
```

Figure 2 continued

```
SEQ ID NO:                          780        790        800        810        820        830        840
 1 88809979[Amaranthus     G........TEDE..PSFVNHLFWS..........NAFPL...Y..............GHNYDSVLRA
75 PPO[Salinibacter_ru     G........VDAS..PVFRRLVHWP..........HAIPQ...Y..............ELGYGTVKDT
76 PPO[Rhodothermus_ma     G........ISGA..PVFRHVWRWE..........RSIPQ...Y..............RLGYDAVLAC
77 Tcastaneum_EST|DT79     G.....KDYNITEIGEVLRSGWVTNENFRGTYSFTRNGLYQ...K..............GVSYQNDLAE
78 Tcastaneum_EST|DN64     G.....RDYNVTEPGEVLWSDWHNNPNFRGTYSYEKNGYFE...E..............EVHYQDHLAE
79 Mycosphaerella_gram     GVDLHPLIIHEQSNDPVTWRSAFNL..DKGAILGLSHSFFNVLCF..............RPSTRARRAG
80 Mycosphaerella_gram     GSYTSMSSWRKEDMPVPRNRGESGR...EGSSMSSRQSRPPLIDFHTAPDAFLPADFEIGRPSKDKRKRS
81 Mycosphaerella_gram     G........IKEA..PEAWQVNLQA..........DCIPQ...Y..............TVGHETRLKK
82 Apisum_EST|CN759425     D........IENE.............................................................
83 Schizophyllum_commu     D........WPEVYEPVYTRVRENR..........DCIPV...P..............APGHLERVLE
   Consensus               G              PV                   P                      Y   LA

SEQ ID NO:                          850        860        870        880        890        900        910
 1 88809979[Amaranthus     IDKMEKD...LPGFFYAG..NHKGGL....SVGKAMA.......SGCKAAELVI.......SYLDSH...
75 PPO[Salinibacter_ru     FDALEAA...HPHLAFAG..NYRAGV....SVGDALT.......SGLEAADRLL................
76 PPO[Rhodothermus_ma     VHDVEMS...RSGLFLAG..NYMEGI....SVIDALH.......TGLKAARAII.......QHLREEAAG
77 Tcastaneum_EST|DT79     PLE.........GLFFAG..EATNPVHFA.TVHGAIE.......SGHREARRIL................
78 Tcastaneum_EST|DN64     PLTQGTT....PVVLFAG..EATHPTHYS.TVHGAIE.......SG........................
79 Mycosphaerella_gram     PLDPLLK..YLSGLYMVG..ASAHPG...TGVPIVLA.......GGKLVAEQVCGDMGVRVPWVVEEGRG
80 Mycosphaerella_gram     ALRTFTMTMERPFTPLLGNENKQSGLRRAQSVKDVVDDQARPGPSPIQLKRREEKRTGTPVYSVVQERAR
81 Mycosphaerella_gram     AHNNIWQ.EYKGRLRVAG..NWMSGV....GVNDCLR.......SAYEVARNLSKD.GTGLQHVGE..AP
82 Apisum_EST|CN759425     ......................................................................
83 Schizophyllum_commu     LRRVLKEGEWQGRMEVVG..AGVGGV....SVGDCVE.......AG...............RWVGEGWGP
   Consensus                             L  AG  N   G    SV DA        SG   A

SEQ ID NO:                          920        930        940        950        960
 1 88809979[Amaranthus     ....IYVKMDEKTA....................................
75 PPO[Salinibacter_ru     ......ETDERATQPH..................................
76 PPO[Rhodothermus_ma     GLAKLVLGD.........................................
77 Tcastaneum_EST|DT79     ....DPRNKN........................................
78 Tcastaneum_EST|DN64     ..................................................
79 Mycosphaerella_gram     KGKEEVKKLDRMEKPETWVKWVGILIALGMVPWILGWVVVLFLAKVASVGW
80 Mycosphaerella_gram     TPAMLHVKDESLEMGMGVGEASNGAVAGKAPRKSKSRLLRLFGQER.....
81 Mycosphaerella_gram     TLRMKPVRPGEKTEES..................................
82 Apisum_EST|CN759425     ...............S..................................
83 Schizophyllum_commu     S...TPQMEDDECDDE..................................
   Consensus
```

non conserved

≥50% conserved all match

Figure 3a

```
SEQ ID NO:                                  10        20        30        40        50        60        70
321 PPO2_AMATU_WC           MVIQSITHLSPNLALPSPLSVSTKNYPVAVMGNISEREEPTSAKRVAVVGAGVSGLAAAYKLKSHGLSVT
84  gi_491060495_WP_004     ....................................MDAPS.............................
85  gi_491073786_WP_004     ....................................MDAPS.............................
86  gi_640671255_WP_025     ....................................MDAPS.............................
87  gi_491300310_WP_005     ....................................MDAPS.............................
88  gi_490943302_WP_004     ....................................MDAPS.............................
89  gi_490801335_WP_004     ....................................MDAPS.............................
90  gi_491463643_WP_005     ....................................MDAPS.............................
91  gi_491381361_WP_005     ....................................MDAPS.............................
92  gi_491292983_WP_005     ....................................MDAPS.............................
93  gi_490793063_WP_004     ....................................MDAPS.............................
94  gi_507093809_WP_016     ....................................MDAPS.............................
95  gi_490909009_WP_004     ....................................MDAPS.............................
96  gi_514351070_WP_016     ....................................MDAPS.............................
97  gi_491371149_WP_005     ....................................MDAPS.............................
98  gi_494745796_WP_007     ....................................MDAPS.............................
99  gi_491426157_WP_005     ....................................MDAPS.............................
100 gi_518214819_WP_019     ....................................MDAPS.............................
101 gi_491233156_WP_005     ....................................MDAPS.............................
102 gi_490807961_WP_004     ....................................MDAPS.............................
103 gi_490832850_WP_004     ....................................MDAPS.............................
104 gi_491199143_WP_005     ....................................MDAPS.............................
105 gi_517509805_WP_018     ....................................MDAPS.............................
106 gi_490968207_WP_004     ....................................MDAPS.............................
107 gi_490775991_WP_004     ....................................MDAPS.............................
108 gi_446262034_WP_000     ....................................MDAPS.............................
109 gi_740513810_WP_038     ....................................MDAPS.............................
110 gi_490783939_WP_004     ....................................MDAPS.............................
111 gi_491019396_WP_004     ....................................MDAPS.............................
    Consensus                                                   MDAPS

SEQ ID NO:                                  80        90       100       110       120       130       140
321 PPO2_AMATU_WC           LFEADSRAGGKLKTVKKNGFIWDEGANTMTESEAEVSSEIDDLGLREKQQLPISQNKRYIARDGLPVLLP
84  gi_491060495_WP_004     .................DAFLW.............VKAL...............................
85  gi_491073786_WP_004     .................DAFLW.............VKAL...............................
86  gi_640671255_WP_025     .................DAFLW.............VKAL...............................
87  gi_491300310_WP_005     .................DAFLW.............VKAL...............................
88  gi_490943302_WP_004     .................DAFLW.............VKAL...............................
89  gi_490801335_WP_004     .................DAFLW.............VKAL...............................
90  gi_491463643_WP_005     .................DAFLW.............VKAL...............................
91  gi_491381361_WP_005     .................DAFLW.............VKAL...............................
92  gi_491292983_WP_005     .................DAFLW.............VKAL...............................
93  gi_490793063_WP_004     .................DAFLW.............VKAL...............................
94  gi_507093809_WP_016     .................DAFLW.............VKAL...............................
95  gi_490909009_WP_004     .................DAFLW.............VKAL...............................
96  gi_514351070_WP_016     .................DAFLW.............VKAL...............................
97  gi_491371149_WP_005     .................DAFLW.............VKAL...............................
98  gi_494745796_WP_007     .................DAFLW.............VKAL...............................
99  gi_491426157_WP_005     .................DAFLW.............VKAL...............................
100 gi_518214819_WP_019     .................DAFLW.............VKAL...............................
101 gi_491233156_WP_005     .................DAFLW.............VKAL...............................
102 gi_490807961_WP_004     .................DAFLW.............VKAL...............................
103 gi_490832850_WP_004     .................DAFLW.............VKAL...............................
104 gi_491199143_WP_005     .................DAFLW.............VKAL...............................
105 gi_517509805_WP_018     .................DAFLW.............VKAL...............................
106 gi_490968207_WP_004     .................EAFLW.............VKAL...............................
107 gi_490775991_WP_004     .................DAFLW.............VKAL...............................
108 gi_446262034_WP_000     .................DAFLW.............VKAL...............................
109 gi_740513810_WP_038     .................DAFLW.............VKAL...............................
110 gi_490783939_WP_004     .................DAFLW.............VKAL...............................
111 gi_491019396_WP_004     .................DAFLW.............VKAL...............................
    Consensus                                DAFLW             VKAL
```

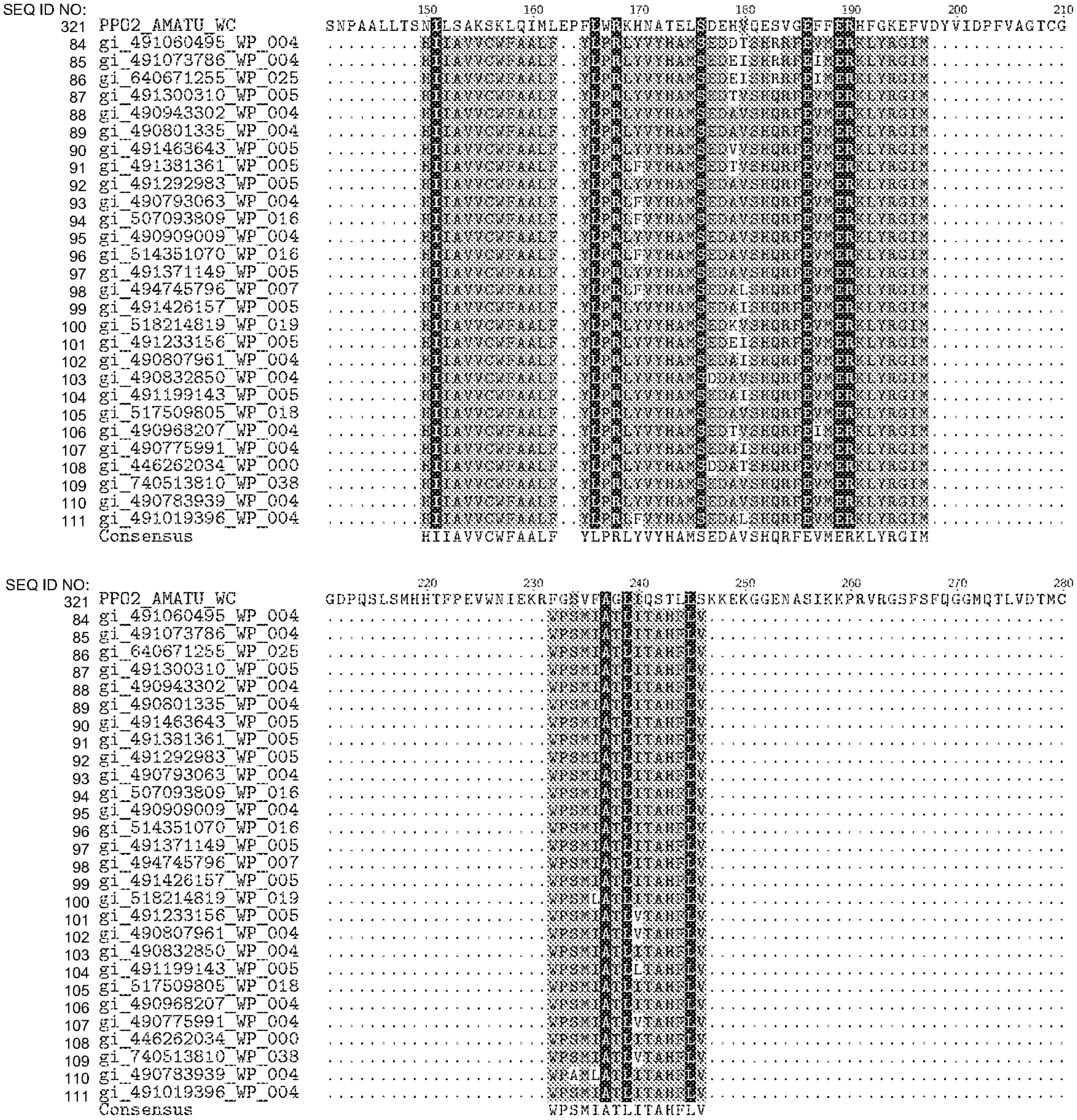

Figure 3a continued

[Sequence alignment figure showing SEQ ID NOs 321, 84-111 with gi accession identifiers (PPO2_AMATU_WC and gi_491060495_WP_004 through gi_491019396_WP_004), aligned across positions 150-280. Consensus sequences shown:]

Positions ~150-210 consensus: HIIAVVCWFAALF YLPRLYVYHAMSEDAVSHQRFEVMERKLYRGIM

PPO2_AMATU_WC (SEQ ID NO: 321) positions 150-210:
SNPAALLTSNILSAKSKLQIMLEPFWKHNATELSDEHQESVGFFSHFGKEFVDYVIDPFVAGTCG Positions ~220-280 consensus: WPSMIATLITAHFLV PPO2_AMATU_WC (SEQ ID NO: 321) positions 220-280:
GDPQSLSMHHTFPEVWNIEKRFGSVFAGIEQSTLISKKEKGGENASIKKPRVRGSFSFQGGMQTLVDTMC

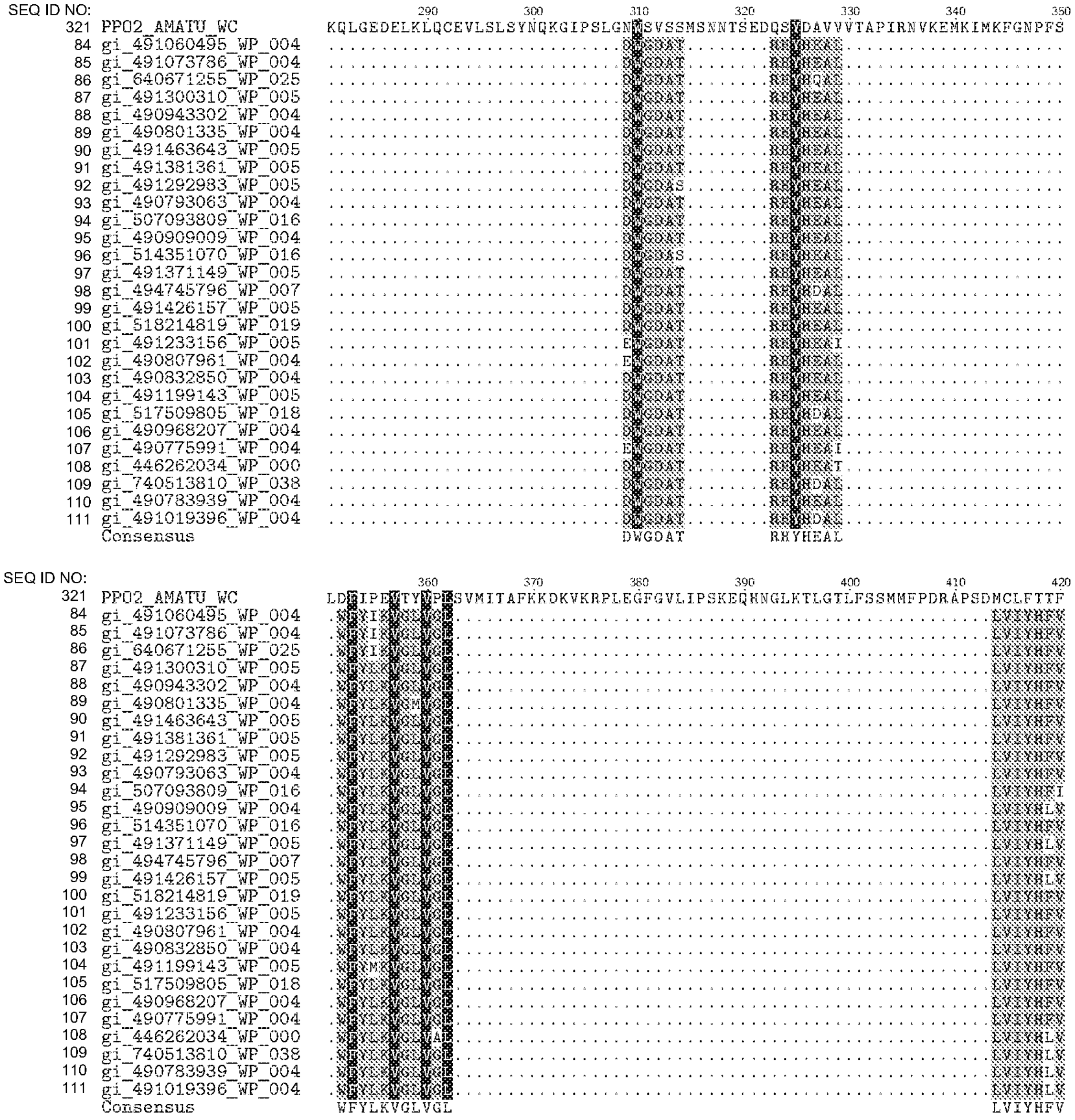

Figure 3a continued

```
SEQ ID NO:                              290       300       310       320       330       340       350
       321 PP02_AMATU_WC         KQLGEDELKLQCEVLSLSYNQKGIPSLGNMSVSSMSNNTSEDQSIDAVVVTAPIRNVKEMKIMKFGNPFS
        84 gi_491060495_WP_004
        85 gi_491073786_WP_004
        86 gi_640671255_WP_025
        87 gi_491300310_WP_005
        88 gi_490943302_WP_004
        89 gi_490801335_WP_004
        90 gi_491463643_WP_005
        91 gi_491381361_WP_005
        92 gi_491292983_WP_005
        93 gi_490793063_WP_004
        94 gi_507093809_WP_016
        95 gi_490909009_WP_004
        96 gi_514351070_WP_016
        97 gi_491371149_WP_005
        98 gi_494745796_WP_007
        99 gi_491426157_WP_005
       100 gi_518214819_WP_019
       101 gi_491233156_WP_005
       102 gi_490807961_WP_004
       103 gi_490832850_WP_004
       104 gi_491199143_WP_005
       105 gi_517509805_WP_018
       106 gi_490968207_WP_004
       107 gi_490775991_WP_004
       108 gi_446262034_WP_000
       109 gi_740513810_WP_038
       110 gi_490783939_WP_004
       111 gi_491019396_WP_004
           Consensus                                         DWGDAT        RRYHEAL

SEQ ID NO:                              360       370       380       390       400       410       420
       321 PP02_AMATU_WC         LDEIPEVTYVPISVMITAFKKDKVKRPLEGFGVLIPSKEQHNGLKTLGTLFSSMMFPDRAPSDMCLFTTF
        84 gi_491060495_WP_004
        ...
           Consensus             WFYLKVGLVGL                                                     LVIYHFV
```

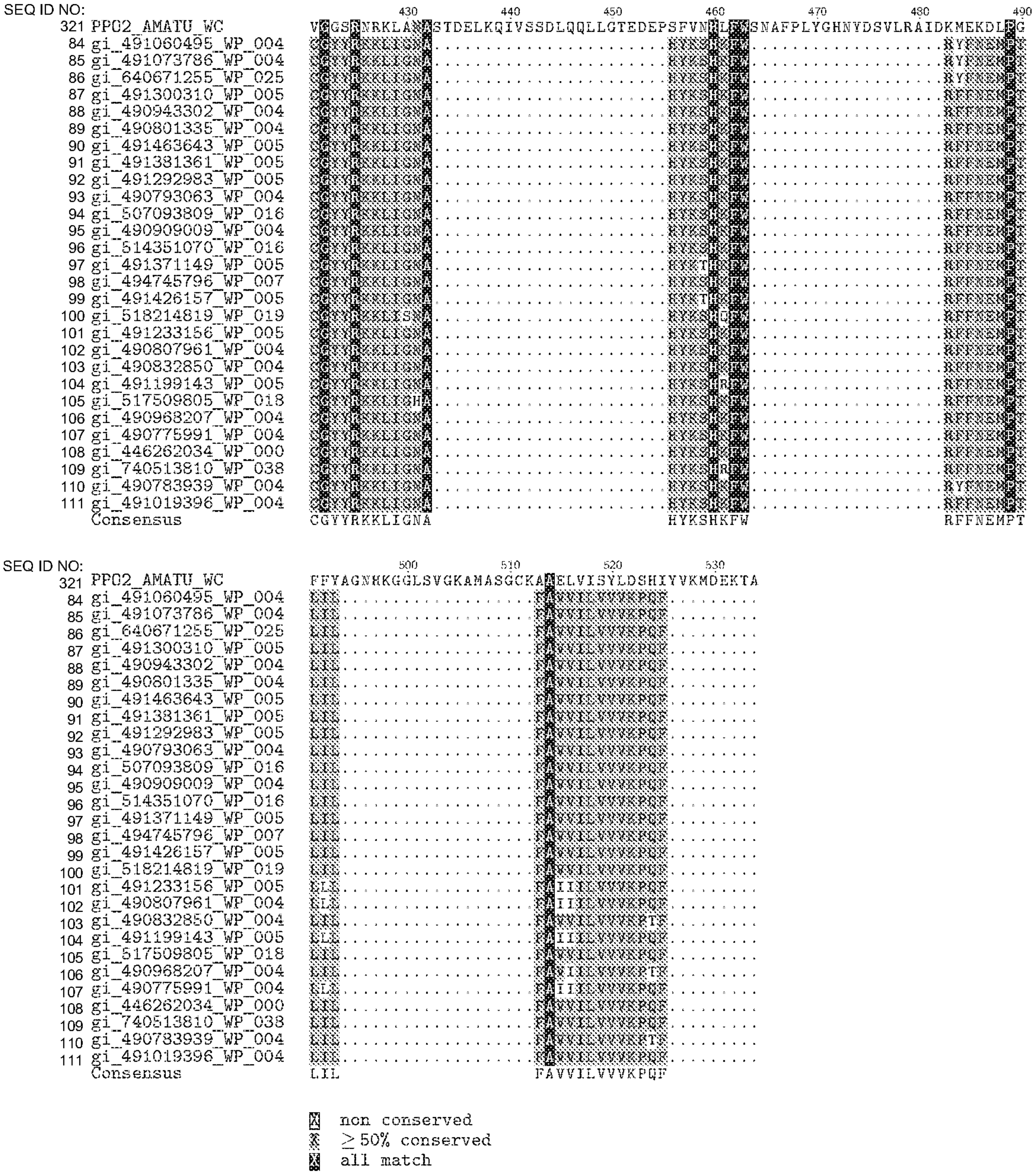

Figure 3a continued

```
SEQ ID NO:                                      430        440        450        460        470        480        490
      321 PPO2_AMATU_WC         VEGSRNRKLANASTDELKQIVSSDLQQLLGTEDEPSFVNRLESSNAFPLYGHNYDSVLRAIDKMEKDLEG
       84 gi_491060495_WP_004   ...............................................................
       85 gi_491073786_WP_004   ...............................................................
       86 gi_640671255_WP_025   ...............................................................
       87 gi_491300310_WP_005   ...............................................................
       88 gi_490943302_WP_004   ...............................................................
       89 gi_490801335_WP_004   ...............................................................
       90 gi_491463643_WP_005   ...............................................................
       91 gi_491381361_WP_005   ...............................................................
       92 gi_491292983_WP_005   ...............................................................
       93 gi_490793063_WP_004   ...............................................................
       94 gi_507093809_WP_016   ...............................................................
       95 gi_490909009_WP_004   ...............................................................
       96 gi_514351070_WP_016   ...............................................................
       97 gi_491371149_WP_005   ...............................................................
       98 gi_494745796_WP_007   ...............................................................
       99 gi_491426157_WP_005   ...............................................................
      100 gi_518214819_WP_019   ...............................................................
      101 gi_491233156_WP_005   ...............................................................
      102 gi_490807961_WP_004   ...............................................................
      103 gi_490832850_WP_004   ...............................................................
      104 gi_491199143_WP_005   ...............................................................
      105 gi_517509805_WP_018   ...............................................................
      106 gi_490968207_WP_004   ...............................................................
      107 gi_490775991_WP_004   ...............................................................
      108 gi_446262034_WP_000   ...............................................................
      109 gi_740513810_WP_038   ...............................................................
      110 gi_490783939_WP_004   ...............................................................
      111 gi_491019396_WP_004   ...............................................................
          Consensus             CGYYRKKLIGNA                     HYKSHKFW              RFFNEMPT

SEQ ID NO:                                      500        510        520        530
      321 PPO2_AMATU_WC         FFYAGNHKGGLSVGKAMASGCKARELVISYLDSHIYVKMDEKTA
       84 gi_491060495_WP_004   ...........................................
       85 gi_491073786_WP_004   ...........................................
       86 gi_640671255_WP_025   ...........................................
       87 gi_491300310_WP_005   ...........................................
       88 gi_490943302_WP_004   ...........................................
       89 gi_490801335_WP_004   ...........................................
       90 gi_491463643_WP_005   ...........................................
       91 gi_491381361_WP_005   ...........................................
       92 gi_491292983_WP_005   ...........................................
       93 gi_490793063_WP_004   ...........................................
       94 gi_507093809_WP_016   ...........................................
       95 gi_490909009_WP_004   ...........................................
       96 gi_514351070_WP_016   ...........................................
       97 gi_491371149_WP_005   ...........................................
       98 gi_494745796_WP_007   ...........................................
       99 gi_491426157_WP_005   ...........................................
      100 gi_518214819_WP_019   ...........................................
      101 gi_491233156_WP_005   ...........................................
      102 gi_490807961_WP_004   ...........................................
      103 gi_490832850_WP_004   ...........................................
      104 gi_491199143_WP_005   ...........................................
      105 gi_517509805_WP_018   ...........................................
      106 gi_490968207_WP_004   ...........................................
      107 gi_490775991_WP_004   ...........................................
      108 gi_446262034_WP_000   ...........................................
      109 gi_740513810_WP_038   ...........................................
      110 gi_490783939_WP_004   ...........................................
      111 gi_491019396_WP_004   ...........................................
          Consensus             LIL               FAVVILVVVKPQF
```

☒ non conserved
☒ ≥ 50% conserved
☒ all match

Figure 3b continued
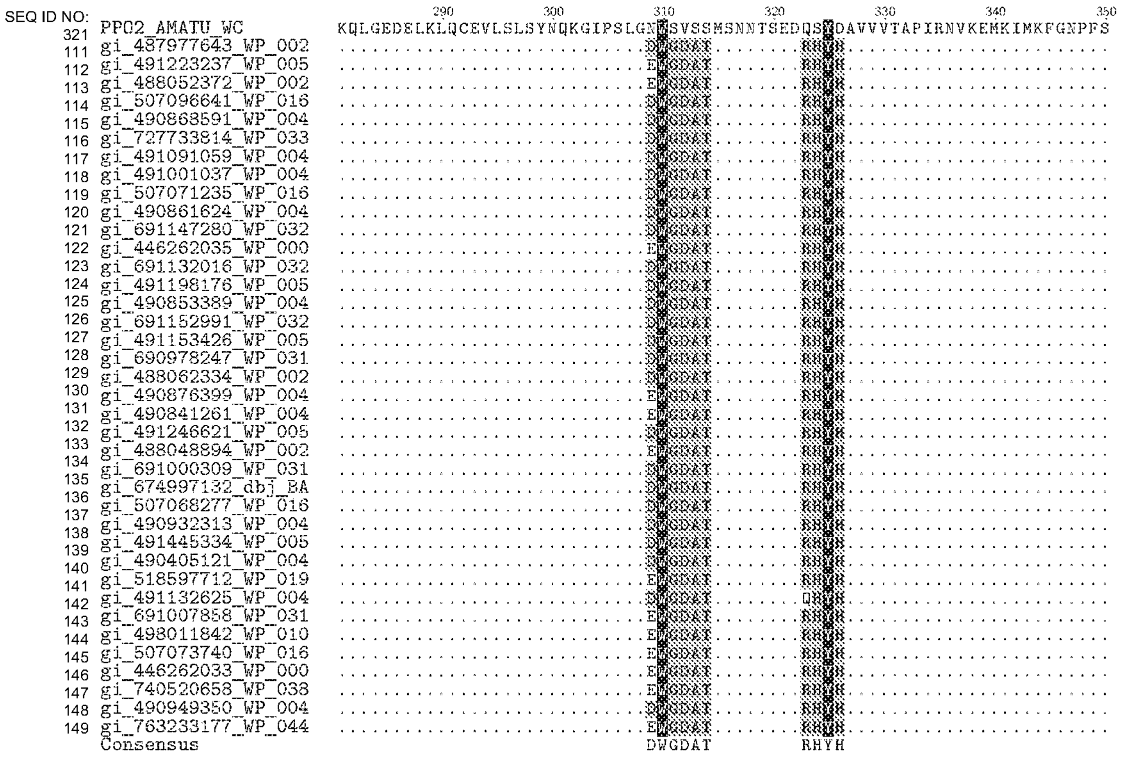
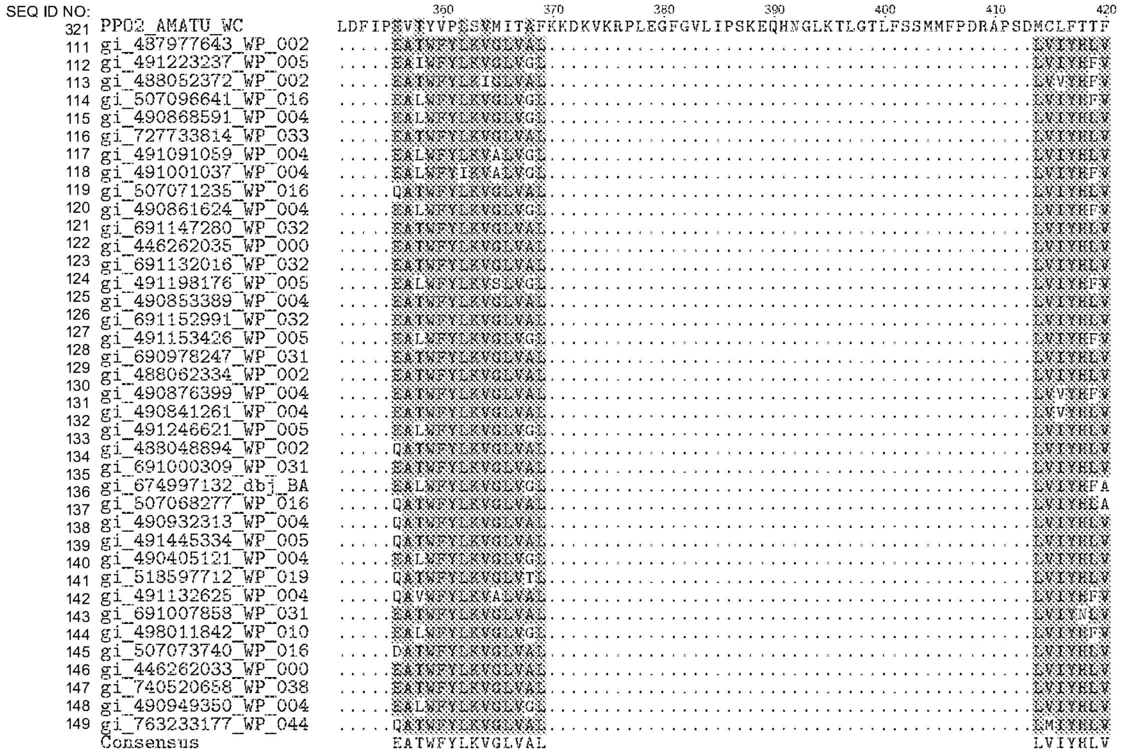

Figure 3c

```
SEQ ID NO:                                     10        20        30        40        50        60        70
321 PPO2_AMATU_WC          MVIQSITHLSPNLALPSPLSVSTKNYPVAVMGNISEREEPTSAKRVAVVGAGVSGLAAAYKLKSHGLSVT
150 gi_491031623_WP_004    ....................................MDAPS.............................
151 gi_502963802_WP_013    ....................................MDAPS.............................
152 gi_757660258_WP_042    ....................................MDAPS.............................
153 gi_491393256_WP_005    ....................................MDAPS.............................
154 gi_737284983_WP_035    ....................................MDAPS.............................
155 gi_490779430_WP_004    ....................................MDAPS.............................
156 gi_491542560_WP_005    ....................................MDAPS.............................
157 gi_736573757_WP_034    ....................................MDAPS.............................
158 gi_491190266_WP_005    ....................................MDAPS.............................
159 gi_806779784_gb_KKC    ....................................MDAPS.............................
160 gi_491314383_WP_005    ....................................MDAPS.............................
161 gi_490921415_WP_004    ....................................MDAPS.............................
162 gi_780011786_WP_045    ....................................MDAPS.............................
163 gi_489749291_WP_003    ....................................MDAPS.............................
164 gi_764631789_WP_044    ....................................MDAPT.............................
165 gi_496875031_WP_009    ....................................MDAPS.............................
166 gi_491376400_WP_005    ....................................MDAPS.............................
167 gi_491184319_WP_005    ....................................MDAPS.............................
168 gi_491116810_WP_004    ....................................MDAPS.............................
169 gi_491237786_WP_005    ....................................MDAPS.............................
170 gi_491321890_WP_005    ....................................MDAPS.............................
171 gi_696292260_WP_032    ....................................MDAPS.............................
172 gi_555507570_WP_023    ....................................MDAPS.............................
173 gi_491160499_WP_005    ....................................MNAPS.............................
174 gi_490814452_WP_004    ....................................MDAPS.............................
175 gi_741483336_gb_KHW    ......................................................................
176 gi_490785848_WP_004    ....................................MDAPS.............................
177 gi_491052309_WP_004    ....................................MDAPS.............................
178 gi_507094777_WP_016    ....................................MDAPS.............................
179 gi_497801016_WP_010    ....................................MNAPS.............................
180 gi_514969048_WP_016    ......................................MVS.............................
181 gi_491040303_WP_004    ....................................MNAPS.............................
182 gi_490888651_WP_004    ....................................MNAPS.............................
183 gi_746597285_WP_039    ....................................MDVPS.............................
    Consensus                                                  MDAPS

SEQ ID NO:                                     80        90       100       110       120       130       140
321 PPO2_AMATU_WC          LFEADSRAGGKLKTVKKDGFIWDEGANTMTESEAEVSSLIDDLGLREKQQLPISQNKRYIARDGLPVLLP
150 gi_491031623_WP_004    .................DAFLW.............VKAL...............................
151 gi_502963802_WP_013    .................DAFLW.............VKAL...............................
152 gi_757660258_WP_042    .................DAFLW.............VKAL...............................
153 gi_491393256_WP_005    .................DAFLW.............VKAL...............................
154 gi_737284983_WP_035    .................DAFLW.............VKAL...............................
155 gi_490779430_WP_004    .................DAFLW.............VKAL...............................
156 gi_491542560_WP_005    .................DAFLW.............VKAL...............................
157 gi_736573757_WP_034    .................DAFLW.............VKAL...............................
158 gi_491190266_WP_005    .................DAFLW.............VKAL...............................
159 gi_806779784_gb_KKC    .................DAFLW.............VKAL...............................
160 gi_491314383_WP_005    .................DAFLW.............VKAL...............................
161 gi_490921415_WP_004    .................DAFLW.............VKAL...............................
162 gi_780011786_WP_045    .................DAFLW.............VKAL...............................
163 gi_489749291_WP_003    .................DAFLW.............VKAL...............................
164 gi_764631789_WP_044    .................DAFLW.............VKAL...............................
165 gi_496875031_WP_009    .................DAFLW.............VKAL...............................
166 gi_491376400_WP_005    .................DAFLW.............VKAL...............................
167 gi_491184319_WP_005    .................DAFLW.............VKAL...............................
168 gi_491116810_WP_004    .................DAFLW.............VKAL...............................
169 gi_491237786_WP_005    .................DAFLW.............VKAL...............................
170 gi_491321890_WP_005    .................DAFLW.............VKAL...............................
171 gi_696292260_WP_032    .................DAFLW.............VKAL...............................
172 gi_555507570_WP_023    .................SAFLW.............VKAL...............................
173 gi_491160499_WP_005    .................DAFFW.............IKAL...............................
174 gi_490814452_WP_004    .................DAFLW.............VKAL...............................
175 gi_741483336_gb_KHW    ....................MW.............VKAL...............................
176 gi_490785848_WP_004    .................DAFLW.............VKAL...............................
177 gi_491052309_WP_004    .................DAFLW.............VKAL...............................
178 gi_507094777_WP_016    .................DAFLW.............VKAL...............................
179 gi_497801016_WP_010    .................EAFLW.............VKAL...............................
180 gi_514969048_WP_016    .................EAFLW.............VKAL...............................
181 gi_491040303_WP_004    .................DAFLW.............VKAL...............................
182 gi_490888651_WP_004    .................DAFLW.............VKAL...............................
183 gi_746597285_WP_039    .................DAFLW.............VKAF...............................
    Consensus                               DAFLW             VKAL
```

Figure 3c continued

```
SEQ ID NO:                                 290       300       310       320       330       340       350
321 PPO2_AMATU_WC         KQLGEDELKLQCEVLSLSYNQKGIPSLGNWSVSSMSNNTSEDQSYDAVVVTAPIRNVKEMKIMKFGNPFS
150 gi_491031623_WP_004   ............................DWGDAT........RHYH........................
151 gi_502963802_WP_013   ............................DWGDAT........RHYH........................
152 gi_757660258_WP_042   ............................EWGDAT........RHYH........................
153 gi_491393256_WP_005   ............................DWGDAT........RHYH........................
154 gi_737284983_WP_035   ............................DWGDAT........RHYH........................
155 gi_490779430_WP_004   ............................EWGDAT........RHYH........................
156 gi_491542560_WP_005   ............................DWGDAT........RHYH........................
157 gi_736573757_WP_034   ............................DWGDAT........RHYH........................
158 gi_491190266_WP_005   ............................EWGDAT........RHYH........................
159 gi_806779784_gb_KKC   ............................DWGDAT........RHYH........................
160 gi_491314383_WP_005   ............................DWGDAT........RHYH........................
161 gi_490921415_WP_004   ............................DWGDAT........RHYH........................
162 gi_780011786_WP_045   ............................EWGDAT........RHYH........................
163 gi_489749291_WP_003   ............................EWGDAT........RHYH........................
164 gi_764631789_WP_044   ............................DWGDGT........QHYH........................
165 gi_496875031_WP_009   ............................DWGDAT........RHYH........................
166 gi_491376400_WP_005   ............................DWGDAT........RHYH........................
167 gi_491184319_WP_005   ............................EWGDAT........RHYH........................
168 gi_491116810_WP_004   ............................DWGDAT........RNYH........................
169 gi_491237786_WP_005   ............................DWGDAT........RHYH........................
170 gi_491321890_WP_005   ............................DWGDAT........RNYH........................
171 gi_696292260_WP_032   ............................DWGDAT........RHYH........................
172 gi_555507570_WP_023   ............................DWGDAT........RHYH........................
173 gi_491160499_WP_005   ............................DWGDQF........YHYH........................
174 gi_490814452_WP_004   ............................DWGDAT........RHYH........................
175 gi_741483336_gb_KHW   ............................DWGDAT........RHYH........................
176 gi_490785848_WP_004   ............................DWGDAT........RHYH........................
177 gi_491052309_WP_004   ............................DWGDAT........RHYH........................
178 gi_507094777_WP_016   ............................DWGDAT........RHYH........................
179 gi_497801016_WP_010   ............................DWGDAT........YHYH........................
180 gi_514969048_WP_016   ............................DWGDAT........QHYH........................
181 gi_491040303_WP_004   ............................AWGDAT........QHYH........................
182 gi_490888651_WP_004   ............................AWGDAT........QHYH........................
183 gi_746597285_WP_039   ............................DWGDAT........QHYH........................
    Consensus                                         DWGDAT        RHYH

SEQ ID NO:                                 360       370       380       390       400       410       420
321 PPO2_AMATU_WC         LDFIPEVTYVPLSVMITAFKKDKVKRPLEGFGVLIPSKEQHNGLKTLGTLFSSMMFPDRAPSDMCLFTTF
150 gi_491031623_WP_004   .....EALWFYLKVGLVGL............................................LVIYHLV
151 gi_502963802_WP_013   .....QATWFYLKVGLVAL............................................LVIYHLA
152 gi_757660258_WP_042   .....QATWFYLKVGLVAL............................................LVIYHLV
153 gi_491393256_WP_005   .....EALWFYLKVGLVGL............................................LVIYHLI
154 gi_737284983_WP_035   .....EALWFYLKVGLVGL............................................LVIYHLM
155 gi_490779430_WP_004   .....QATWFYLKVALVAL............................................LVIYHLV
156 gi_491542560_WP_005   .....EALWFYLKVGLVGL............................................LVIYHFV
157 gi_736573757_WP_034   .....EALWFYLKVGLVGL............................................LVIYHLV
158 gi_491190266_WP_005   .....QATWFYLKVALVAL............................................LVIYHLV
159 gi_806779784_gb_KKC   .....QATWFYLKVALVAL............................................LVIYHLA
160 gi_491314383_WP_005   .....EALWFYLKVGLVGL............................................LVIYHLV
161 gi_490921415_WP_004   .....EALWFYLKVGLVGL............................................LVIYHLV
162 gi_780011786_WP_045   .....QATWFYLKVALVAL............................................LIIYHLV
163 gi_489749291_WP_003   .....QATWFYLKVALVAL............................................LVIYHLV
164 gi_764631789_WP_044   .....QAGWFYLKVALVAL............................................LVIYHFV
165 gi_496875031_WP_009   .....QATWFYLKVALVAL............................................LVIYHLA
166 gi_491376400_WP_005   .....EALWFYLKVGLVGL............................................LVIYHLI
167 gi_491184319_WP_005   .....QATWFYLKVALVAL............................................LVIYHLV
168 gi_491116810_WP_004   .....DALWFYLKVALVGL............................................LVIYHLV
169 gi_491237786_WP_005   .....EAVWFYLKVGLVGL............................................LVIYHLV
170 gi_491321890_WP_005   .....DALWFYLKVALVGL............................................LVIYHLV
171 gi_696292260_WP_032   .....EALWFYLKVGLVGL............................................LVIYHLV
172 gi_555507570_WP_023   .....EALWFYFKVGLVGL............................................LIIYHFV
173 gi_491160499_WP_005   .....EALWFYLKVALVGL............................................LVIYHFV
174 gi_490814452_WP_004   .....EALWFYLKVGLVGL............................................LVIYHFV
175 gi_741483336_gb_KHW   .....EATWFYLKVGLVAL............................................LVIYHLV
176 gi_490785848_WP_004   .....EALWFYLKVGLVGL............................................LVIYHFV
177 gi_491052309_WP_004   .....EALWFYLKVALVGL............................................LVIYHLV
178 gi_507094777_WP_016   .....EALWFYLKVGLVGL............................................LVIYHFV
179 gi_497801016_WP_010   .....EALWFYLKVGLVGL............................................LVIYHFV
180 gi_514969048_WP_016   .....EATWFYIKVALVGL............................................LVIYHFV
181 gi_491040303_WP_004   .....LAHWFYVKVALVGL............................................LVIYHFV
182 gi_490888651_WP_004   .....LAHWFYLKVALVGL............................................LVIYHFV
183 gi_746597285_WP_039   .....EALWFYLKLGLVGL............................................LVIYHLF
    Consensus                   A WFYLKV LV L                                              LVIYH V
```

Figure 4a

| SEQ ID NO: | | 10 20 30 40 50 60 70 |
|---|---|---|
| 322 | PPO2_AMATU | MGNISEREEPTSAKRVAVVGAGVSGLAAAYKLKSHGLSVTLFEADSRAGGKLKTVKKDGFIWDEGANTMT |
| 184 | hemG | ...................................MKTLILFST............RDG........QTR |
| 185 | gi_446776703_WP_000 | ...................................MKTLILFST............RDG........QTR |
| 186 | gi_585368532_WP_024 | ...................................MKTLILFST............RDG........QTR |
| 187 | gi_446776716_WP_000 | ...................................MKTLILFST............RDG........QTR |
| 188 | gi_803576760_WP_046 | ...................................MKTLILFST............RDG........QTR |
| 189 | gi_446776730_WP_000 | ...................................MKTLILFST............RDG........QTR |
| 190 | gi_446776711_WP_000 | ...................................MKTLILFST............RDG........QTR |
| 191 | gi_507088140_WP_016 | ...................................MKTLILFST............RDG........QTR |
| 192 | gi_745765271_WP_039 | ...................................MKTLILFST............RDG........QTR |
| 193 | gi_446776709_WP_000 | ...................................MKTLILFST............RDG........QTR |
| 194 | gi_446776715_WP_000 | ...................................MKTLILFST............RDG........QTR |
| 195 | gi_446776710_WP_000 | ...................................MKTLILFST............RDG........QTR |
| 196 | gi_446776697_WP_000 | ...................................MKTLILFST............RDG........QTR |
| 197 | gi_446776718_WP_000 | ...................................MKTLILFST............RDG........QTR |
| 198 | gi_446776720_WP_000 | ...................................MKTLILFST............RDG........QTR |
| 199 | gi_446776717_WP_000 | ...................................MKTLILFST............RDG........QTR |
| 200 | gi_554685272_WP_023 | ...................................MKTLILFST............RDG........QTR |
| 201 | gi_308927673_gb_EFP | ...................................................................... |
| 202 | gi_754936070_WP_042 | ...................................MKTLILFST............RDG........QTR |
| 203 | gi_446776725_WP_000 | ...................................MKTLILFST............RDG........QTR |
| 204 | gi_721474711_gb_KGY | ...................................MKTLILFST............RDG........QTR |
| 205 | gi_446776724_WP_000 | ...................................MKTLILFST............RDG........QTR |
| 206 | gi_740611784_WP_038 | ...................................MKTLILFST............RDG........QTR |
| 207 | gi_526249624_Poxida | ...................................MKTLILFST............RDG........QTR |
| 208 | gi_157081684_gb_ABV | ...................................MKTLILFST............RDG........QTR |
| 209 | gi_685237852_WP_031 | ...................................MKTLILFST............RDG........QTR |
| 210 | gi_502672073_WP_012 | ...................................MKTLILFSS............RDG........QTR |
| 211 | gi_446776722_WP_000 | ...................................MKTLILFST............RDG........QTR |
| 212 | gi_673531409_emb_CD | ...................................MKTLILFST............RDG........QTR |
| 213 | gi_446776726_WP_000 | ...................................MKTLILFST............RDG........QTR |
| 214 | gi_554246566_gb_ESG | ...................................MKTLILFST............RDG........QTR |
| 215 | gi_555286377_WP_023 | ...................................MKTLILFST............RDG........QTR |
| 216 | gi_446776696_WP_000 | ...................................MKTLILFST............RDG........QTR |
| 217 | gi_446776729_WP_000 | ...................................MKTLILFST............RDG........QTR |
| 218 | gi_521135495_WP_020 | ...................................MKTLILFST............RDG........QTR |
| 219 | gi_565623524_WP_023 | ...................................MKTLILFST............RDG........QTR |
| 220 | gi_446776727_WP_000 | ...................................MKTLILFST............RDG........QTR |
| 221 | gi_446776692_WP_000 | ...................................MKTLILFST............RDG........QTH |
| 222 | gi_446776723_WP_000 | ...................................MKTLILFST............RDG........QTR |
| 223 | gi_446776728_WP_000 | ...................................MKTLILFST............RDG........QTR |
| 224 | gi_446776731_WP_000 | ...................................MKTLILFST............WDG........QTR |
| 225 | gi_740607825_WP_038 | ...................................MKTLILFST............RDG........QTR |
| 226 | gi_555219141_WP_023 | ...................................MKTLILFST............RDG........QTR |
| 227 | gi_487372158_WP_001 | ...................................MKTLILFST............RDG........QTR |
| 228 | gi_555265933_WP_023 | ...................................MKILILFST............RDG........QTR |
| 229 | gi_754970294_WP_042 | ...................................MKTLILFSS............RDG........QTR |
| 230 | gi_763106372_WP_043 | ...................................MKTLILFST............RDG........QTR |
| 231 | gi_555241082_WP_023 | ...................................MKTLILFST............RDG........QTR |
| | Consensus | MKTLILFST RDG QTR |

Figure 4a continued

```
SEQ ID NO:                                 80        90        100       110       120       130       140
322 PPO2_AMATU              ESEAEVSSLIDDLGLREKQQLPISQNKRYIARDGLPVLLPSNPAALLTSNILSAKSKLQIMLEPFLWRKH
184 hemG                   KIASYLASELKELG....................................................IQ...
185 gi_446776703_WP_000     EIASYLASELKELG....................................................IQ...
186 gi_585368532_WP_024     KIASYLASELKELG....................................................IQ...
187 gi_446776716_WP_000     EIASYLASELKELG....................................................IQ...
188 gi_803576760_WP_046     EIAAYLASELKELG....................................................IQ...
189 gi_446776730_WP_000     EISSYLASELKELG....................................................IQ...
190 gi_446776711_WP_000     EIASYLASELKELG....................................................IQ...
191 gi_507088140_WP_016     KIASYLASELKELG....................................................IQ...
192 gi_745765271_WP_039     EIASYLASELKELG....................................................IQ...
193 gi_446776709_WP_000     EIASYLASELKELG....................................................IQ...
194 gi_446776715_WP_000     EIASYLASELKELG....................................................IQ...
195 gi_446776710_WP_000     EIASYLASELKELG....................................................IQ...
196 gi_446776697_WP_000     KIASYLASELKELG....................................................IL...
197 gi_446776718_WP_000     EIASYLASELKELG....................................................IQ...
198 gi_446776720_WP_000     EIASYLASELKELG....................................................IQ...
199 gi_446776717_WP_000     EIASYLASELKELG....................................................IQ...
200 gi_554685272_WP_023     EIASYLASELKEMG....................................................IW...
201 gi_308927673_gb_EFP     .....MASELKELG....................................................IQ...
202 gi_754936070_WP_042     EIASYLASELKELG....................................................IW...
203 gi_446776725_WP_000     KIASYLASELKEMG....................................................IW...
204 gi_721474711_gb_KGY     EIASYLASELKELG....................................................IW...
205 gi_446776724_WP_000     EIASYLASELKEMG....................................................IW...
206 gi_740611784_WP_038     EIASYLASELKEMG....................................................IW...
207 gi_526249624_Poxida     EIASYLASELKEMG....................................................IW...
208 gi_157081684_gb_ABV     KIASYLASELKELG....................................................IW...
209 gi_685237852_WP_031     EIASYLASELKEMG....................................................IR...
210 gi_502672073_WP_012     EIAAYLASELKELG....................................................IW...
211 gi_446776722_WP_000     EIASYLASELKEMG....................................................IW...
212 gi_673531409_emb_CD     EIASYLASELKALG....................................................IW...
213 gi_446776726_WP_000     KIASYLASELKEMG....................................................IW...
214 gi_554246566_gb_ESG     EIASYLASELKEMG....................................................IW...
215 gi_555286377_WP_023     EIASYLASELKEMG....................................................IW...
216 gi_446776696_WP_000     EIASYLASELKDMG....................................................IW...
217 gi_446776729_WP_000     EIASYLASELKEMG....................................................IW...
218 gi_521135495_WP_020     KIASYLASELKEMG....................................................IW...
219 gi_565623524_WP_023     EIASYLASELKEMG....................................................IW...
220 gi_446776727_WP_000     KIASYLASELKEMG....................................................IW...
221 gi_446776692_WP_000     EIASYLASELKEMG....................................................IW...
222 gi_446776723_WP_000     EIASYLASELKEMG....................................................IW...
223 gi_446776728_WP_000     KIASYLASELKEMG....................................................IW...
224 gi_446776731_WP_000     EIASYLASELKEMG....................................................IW...
225 gi_740607825_WP_038     KIASYLASELKEMG....................................................IW...
226 gi_555219141_WP_023     EIASYLASELKEMG....................................................IW...
227 gi_487372158_WP_001     EIASYLASELKEMG....................................................IW...
228 gi_555265933_WP_023     EIASYLASELKEMG....................................................IW...
229 gi_754970294_WP_042     EIAAYLASELKELG....................................................IC...
230 gi_763106372_WP_043     KIASYLASELKEMG....................................................IW...
231 gi_555241082_WP_023     EIASYLASELKEMG....................................................IW...
    Consensus               EIASYLASELKEMG                                                    IW
```

Figure 4a continued

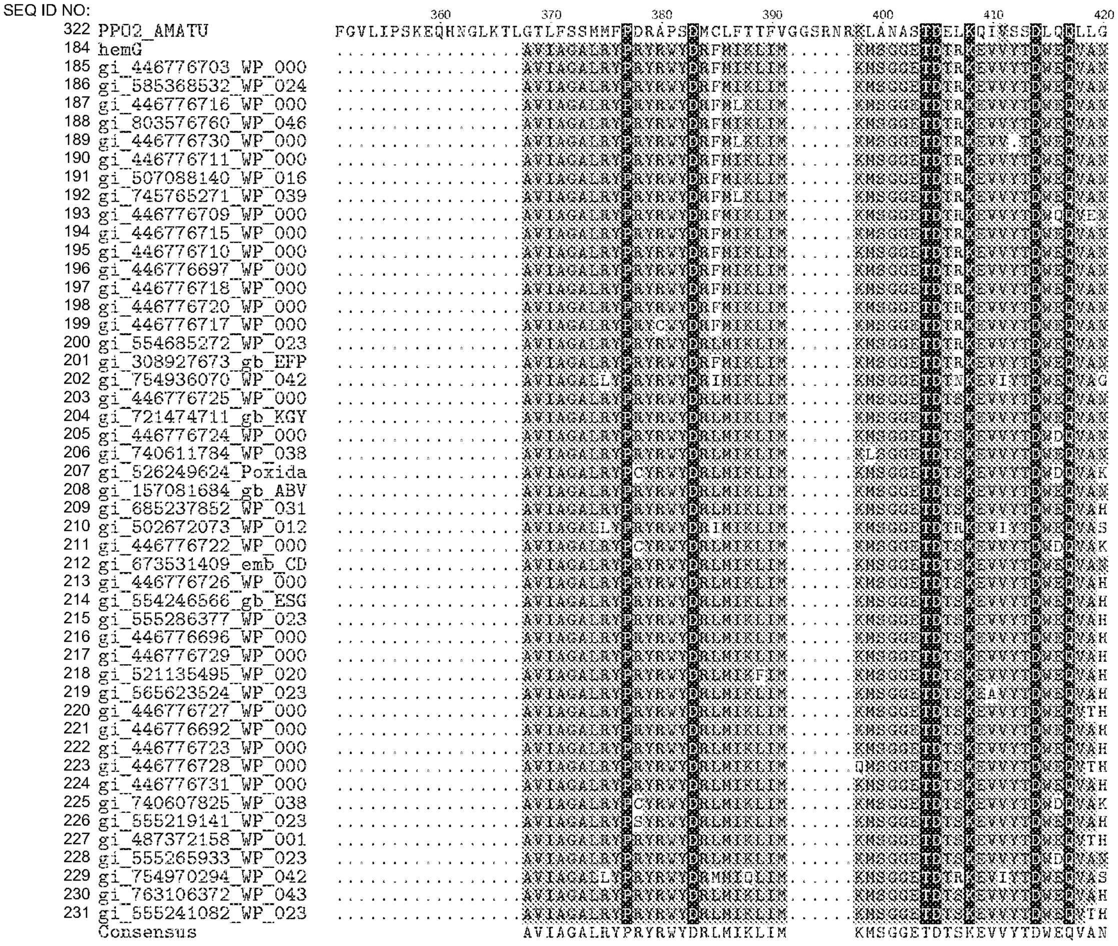

```
SEQ ID NO:                            360        370        380        390        400        410        420
    322 PP02_AMATU           FGVLIPSKEQHNGLKTLGTLFSSMMFEDRAPSDMCLFTTFVGGSRNRKLANASDELKQISSDLQRLLG
    184 hemG
    185 gi_446776703_WP_000
    186 gi_585368532_WP_024
    187 gi_446776716_WP_000
    188 gi_803576760_WP_046
    189 gi_446776730_WP_000
    190 gi_446776711_WP_000
    191 gi_507088140_WP_016
    192 gi_745765271_WP_039
    193 gi_446776709_WP_000
    194 gi_446776715_WP_000
    195 gi_446776710_WP_000
    196 gi_446776697_WP_000
    197 gi_446776718_WP_000
    198 gi_446776720_WP_000
    199 gi_446776717_WP_000
    200 gi_554685272_WP_023
    201 gi_308927673_gb_EFP
    202 gi_754936070_WP_042
    203 gi_446776725_WP_000
    204 gi_721474711_gb_KGY
    205 gi_446776724_WP_000
    206 gi_740611784_WP_038
    207 gi_526249624_Poxida
    208 gi_157081684_gb_ABV
    209 gi_685237852_WP_031
    210 gi_502672073_WP_012
    211 gi_446776722_WP_000
    212 gi_673531409_emb_CD
    213 gi_446776726_WP_000
    214 gi_554246566_gb_ESG
    215 gi_555286377_WP_023
    216 gi_446776696_WP_000
    217 gi_446776729_WP_000
    218 gi_521135495_WP_020
    219 gi_565623524_WP_023
    220 gi_446776727_WP_000
    221 gi_446776692_WP_000
    222 gi_446776723_WP_000
    223 gi_446776728_WP_000
    224 gi_446776731_WP_000
    225 gi_740607825_WP_038
    226 gi_555219141_WP_023
    227 gi_487372158_WP_001
    228 gi_555265933_WP_023
    229 gi_754970294_WP_042
    230 gi_763106372_WP_043
    231 gi_555241082_WP_023
        Consensus                          AVIAGALRYPRYRWYDRLMIKLIM      KMSGGETDTSKEVVYTDWEQVAN
```

Figure 4a continued

| SEQ ID NO: | | 430 440 450 460 470 480 490 |
|---|---|---|
| 322 | PPO2_AMATU | TEDEPSFVNHLFWSNAFPLYGHNYDSVLRAIDKMEKDLPGFFYAGNHKGGLSVGKAMASGCKAAELVISY |
| 184 | hemG | FARE...............................................................IAH |
| 185 | gi_446776703_WP_000 | FARE...............................................................IAH |
| 186 | gi_585368532_WP_024 | FARE...............................................................IAH |
| 187 | gi_446776716_WP_000 | FARE...............................................................IAH |
| 188 | gi_803576760_WP_046 | FARE...............................................................IAH |
| 189 | gi_446776730_WP_000 | FARE...............................................................IAH |
| 190 | gi_446776711_WP_000 | FARE...............................................................IAH |
| 191 | gi_507088140_WP_016 | FARE...............................................................IAH |
| 192 | gi_745765271_WP_039 | FARE...............................................................IAH |
| 193 | gi_446776709_WP_000 | FARE...............................................................IAH |
| 194 | gi_446776715_WP_000 | FARE...............................................................IAQ |
| 195 | gi_446776710_WP_000 | FARE...............................................................IAH |
| 196 | gi_446776697_WP_000 | FARE...............................................................IAH |
| 197 | gi_446776718_WP_000 | FARE...............................................................IAQ |
| 198 | gi_446776720_WP_000 | FARE...............................................................IAQ |
| 199 | gi_446776717_WP_000 | FARE...............................................................IAQ |
| 200 | gi_554685272_WP_023 | FARE...............................................................IAH |
| 201 | gi_308927673_gb_EFP | FARE...............................................................IAH |
| 202 | gi_754936070_WP_042 | FARE...............................................................IAQ |
| 203 | gi_446776725_WP_000 | FARE...............................................................IAH |
| 204 | gi_721474711_gb_KGY | FARD...............................................................IAQ |
| 205 | gi_446776724_WP_000 | FARE...............................................................IAH |
| 206 | gi_740611784_WP_038 | FARE...............................................................IAH |
| 207 | gi_526249624_Poxida | FARE...............................................................IAH |
| 208 | gi_157081684_gb_ABV | FARD...............................................................IAQ |
| 209 | gi_685237852_WP_031 | FARE...............................................................IAH |
| 210 | gi_502672073_WP_012 | FARE...............................................................IAQ |
| 211 | gi_446776722_WP_000 | FARE...............................................................IAH |
| 212 | gi_673531409_emb_CD | FARD...............................................................IAQ |
| 213 | gi_446776726_WP_000 | FARE...............................................................IAH |
| 214 | gi_554246566_gb_ESG | FARE...............................................................IAH |
| 215 | gi_555286377_WP_023 | FARE...............................................................IAH |
| 216 | gi_446776696_WP_000 | FARE...............................................................IAH |
| 217 | gi_446776729_WP_000 | FARE...............................................................IAH |
| 218 | gi_521135495_WP_020 | FARE...............................................................IAH |
| 219 | gi_565623524_WP_023 | FARE...............................................................IAH |
| 220 | gi_446776727_WP_000 | FARE...............................................................IAH |
| 221 | gi_446776692_WP_000 | FARE...............................................................IAH |
| 222 | gi_446776723_WP_000 | FARE...............................................................IAH |
| 223 | gi_446776728_WP_000 | FARE...............................................................IAH |
| 224 | gi_446776731_WP_000 | FARE...............................................................IAH |
| 225 | gi_740607825_WP_038 | FARE...............................................................IAH |
| 226 | gi_555219141_WP_023 | FARE...............................................................IAH |
| 227 | gi_487372158_WP_001 | FARE...............................................................IAH |
| 228 | gi_555265933_WP_023 | FARE...............................................................IAH |
| 229 | gi_754970294_WP_042 | FARE...............................................................VAQ |
| 230 | gi_763106372_WP_043 | FARE...............................................................IAH |
| 231 | gi_555241082_WP_023 | FARE...............................................................IAH |
| | Consensus | FARE IAH |

Figure 4a continued

| SEQ ID NO: | | 500 |
|---|---|---|
| 322 | PPO2_AMATU | LDSHIYVKMDEKTA |
| 184 | hemG | LTDKPTLK...... |
| 185 | gi_446776703_WP_000 | LTDKPTLK...... |
| 186 | gi_585368532_WP_024 | LTDKPTLK...... |
| 187 | gi_446776716_WP_000 | LTDKPTLK...... |
| 188 | gi_803576760_WP_046 | LTDKPTLK...... |
| 189 | gi_446776730_WP_000 | LTDKPTLK...... |
| 190 | gi_446776711_WP_000 | LTDKPTLK...... |
| 191 | gi_507088140_WP_016 | LTDKPTPK...... |
| 192 | gi_745765271_WP_039 | LTDKPTLK...... |
| 193 | gi_446776709_WP_000 | LTDKPTLK...... |
| 194 | gi_446776715_WP_000 | LTNKPTLK...... |
| 195 | gi_446776710_WP_000 | LTDKPTLK...... |
| 196 | gi_446776697_WP_000 | LTDKPTMK...... |
| 197 | gi_446776718_WP_000 | LTNKPTLK...... |
| 198 | gi_446776720_WP_000 | LTNKPTLK...... |
| 199 | gi_446776717_WP_000 | LTNKPTLK...... |
| 200 | gi_554685272_WP_023 | LTNKSSAK...... |
| 201 | gi_308927673_gb_EFP | LTDKPTLK...... |
| 202 | gi_754936070_WP_042 | LTVKSPVK...... |
| 203 | gi_446776725_WP_000 | LTNKSSAK...... |
| 204 | gi_721474711_gb_KGY | LTNKSLAK...... |
| 205 | gi_446776724_WP_000 | LTNKSSAK...... |
| 206 | gi_740611784_WP_038 | LTNKSSAK...... |
| 207 | gi_526249624_Poxida | LTNKPSSK...... |
| 208 | gi_157081684_gb_ABV | LTNKSLAK...... |
| 209 | gi_685237852_WP_031 | LTNKSSAK...... |
| 210 | gi_502672073_WP_012 | LTDKSSVK...... |
| 211 | gi_446776722_WP_000 | LTNKPSSK...... |
| 212 | gi_673531409_emb_CD | LTNKSLAK...... |
| 213 | gi_446776726_WP_000 | LTNKSSAK...... |
| 214 | gi_554246566_gb_ESG | LTNKSSAK...... |
| 215 | gi_555286377_WP_023 | LTNKSSAK...... |
| 216 | gi_446776696_WP_000 | LTNKSSAK...... |
| 217 | gi_446776729_WP_000 | LTNKSSAK...... |
| 218 | gi_521135495_WP_020 | LTNKSSAK...... |
| 219 | gi_565623524_WP_023 | LTNKSSAK...... |
| 220 | gi_446776727_WP_000 | LTNKSSAK...... |
| 221 | gi_446776692_WP_000 | LTNKSSAK...... |
| 222 | gi_446776723_WP_000 | LTNKSSAK...... |
| 223 | gi_446776728_WP_000 | LTNKSSAK...... |
| 224 | gi_446776731_WP_000 | LTNKSSAK...... |
| 225 | gi_740607825_WP_038 | LTNKLSSK...... |
| 226 | gi_555219141_WP_023 | LTNKSSAK...... |
| 227 | gi_487372158_WP_001 | LNNKSSAK...... |
| 228 | gi_555265933_WP_023 | LTNKSSAK...... |
| 229 | gi_754970294_WP_042 | LTPDSLVK...... |
| 230 | gi_763106372_WP_043 | LTN........... |
| 231 | gi_555241082_WP_023 | LTNKSSAK...... |
| | Consensus | LTNKSS K |

X non conserved
X ≥ 50% conserved
X all match

Figure 4b

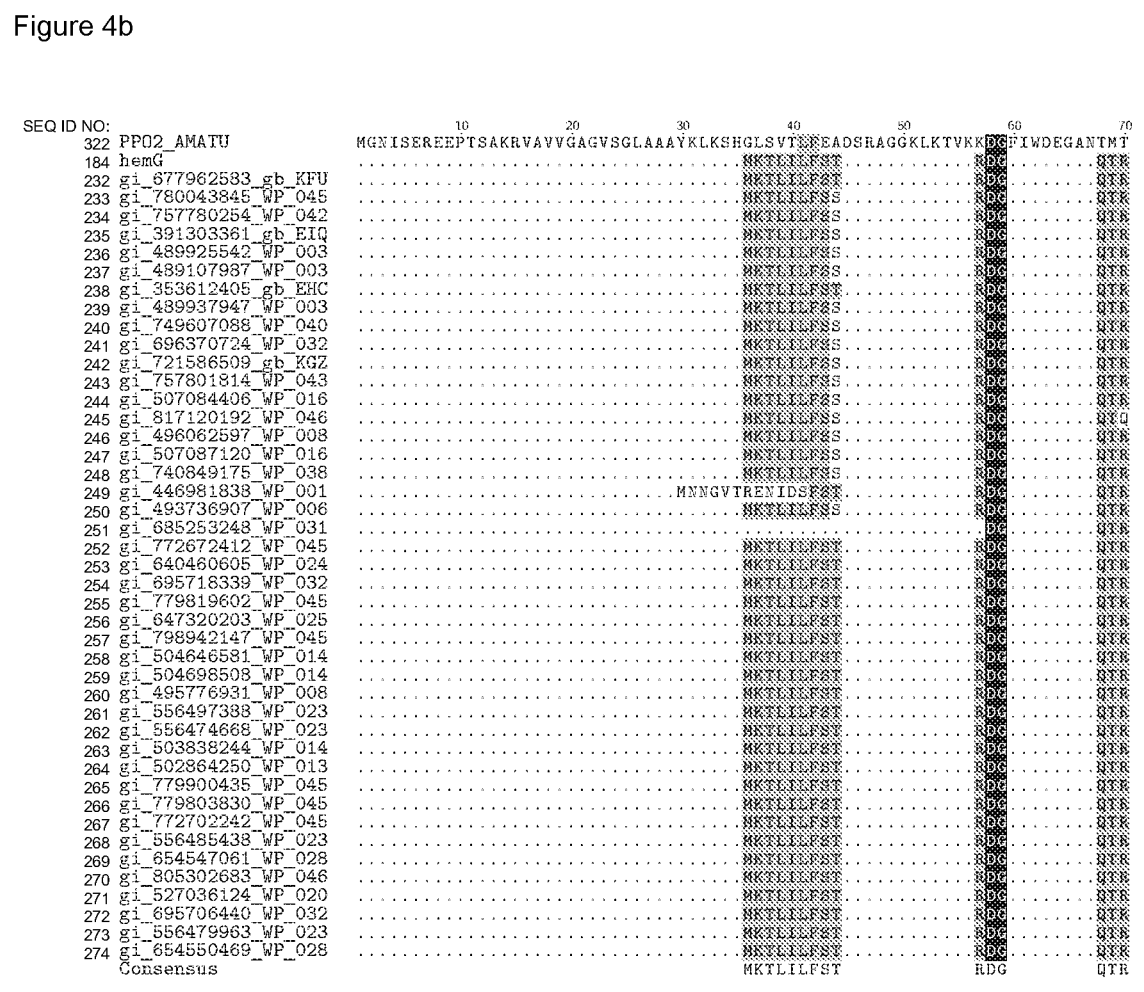

| SEQ ID NO: | | 1–35 | 36–44 | 45–56 | 57–59 | 60–67 | 68–70 |
|---|---|---|---|---|---|---|---|
| 322 | PPO2_AMATU | MGNISEREEPTSAKRVAVVGAGVSGLAAAYKLKSH | GLSVTLFEA | DSRAGGKLKTVK | KDG | FIWDEGAN | TMT |
| 184 | hemG | | MKTLILFST | | RDG | | QTR |
| 232 | gi_677962583_gb_KFU | | MKTLILFST | | RDG | | QTR |
| 233 | gi_780043845_WP_045 | | MKTLILFSS | | RDG | | QTR |
| 234 | gi_757780254_WP_042 | | MKTLILFSS | | RDG | | QTR |
| 235 | gi_391303361_gb_EIQ | | MKTLILFSS | | RDG | | QTR |
| 236 | gi_489925542_WP_003 | | MKTLILFSS | | RDG | | QTR |
| 237 | gi_489107987_WP_003 | | MKTLILFSS | | RDG | | QTR |
| 238 | gi_353612405_gb_EHC | | MKTLILFST | | RDG | | QTR |
| 239 | gi_489937947_WP_003 | | MKTLILFSS | | RDG | | QTR |
| 240 | gi_749607088_WP_040 | | MKTLILFSS | | RDG | | QTR |
| 241 | gi_696370724_WP_032 | | MKTLILFSS | | RDG | | QTR |
| 242 | gi_721586509_gb_KGZ | | MKTLILFSS | | RDG | | QTR |
| 243 | gi_757801814_WP_043 | | MKTLILFSS | | RDG | | QTR |
| 244 | gi_507084406_WP_016 | | MKTLILFSS | | RDG | | QTR |
| 245 | gi_817120192_WP_046 | | MKTLILFSS | | RDG | | QTQ |
| 246 | gi_496062597_WP_008 | | MKTLILFSS | | RDG | | QTR |
| 247 | gi_507087120_WP_016 | | MKTLILFSS | | RDG | | QTR |
| 248 | gi_740849175_WP_038 | | MKTLILFSS | | RDG | | QTR |
| 249 | gi_446981838_WP_001 | MNNGVT | RENIDSFST | | RDG | | QTR |
| 250 | gi_493736907_WP_006 | | MKTLILFSS | | RDG | | QTR |
| 251 | gi_685253248_WP_031 | | | | DG | | QTR |
| 252 | gi_772672412_WP_045 | | MKTLILFST | | RDG | | QTR |
| 253 | gi_640460605_WP_024 | | MKTLILFST | | RDG | | QTR |
| 254 | gi_695718339_WP_032 | | MKTLILFST | | RDG | | QTR |
| 255 | gi_779819602_WP_045 | | MKTLILFST | | RDG | | QTR |
| 256 | gi_647320203_WP_025 | | MKTLILFST | | RDG | | QTR |
| 257 | gi_798942147_WP_045 | | MKTLILFST | | RDG | | QTR |
| 258 | gi_504646581_WP_014 | | MKTLILFST | | RDG | | QTR |
| 259 | gi_504698508_WP_014 | | MKTLILFST | | RDG | | QTR |
| 260 | gi_495776931_WP_008 | | MKTLILFST | | RDG | | QTR |
| 261 | gi_556497388_WP_023 | | MKTLILFST | | RDG | | QTR |
| 262 | gi_556474668_WP_023 | | MKTLILFST | | RDG | | QTR |
| 263 | gi_503838244_WP_014 | | MKTLILFST | | RDG | | QTR |
| 264 | gi_502864250_WP_013 | | MKTLILFST | | RDG | | QTR |
| 265 | gi_779900435_WP_045 | | MKTLILFST | | RDG | | QTR |
| 266 | gi_779803830_WP_045 | | MKTLILFST | | RDG | | QTR |
| 267 | gi_772702242_WP_045 | | MKTLILFST | | RDG | | QTR |
| 268 | gi_556485438_WP_023 | | MKTLILFST | | RDG | | QTR |
| 269 | gi_654547061_WP_028 | | MKTLILFST | | RDG | | QTR |
| 270 | gi_805302683_WP_046 | | MKTLILFST | | RDG | | QTR |
| 271 | gi_527036124_WP_020 | | MKTLILFST | | RDG | | QTR |
| 272 | gi_695706440_WP_032 | | MKTLILFST | | RDG | | QTR |
| 273 | gi_556479963_WP_023 | | MKTLILFST | | RDG | | QTR |
| 274 | gi_654550469_WP_028 | | MKTLILFST | | RDG | | QTR |
| | Consensus | | MKTLILFST | | RDG | | QTR |

Figure 4b continued

```
SEQ ID NO:                                      80         90        100        110        120        130        140
322 PPO2_AMATU              ESEAEVSSLIDDLGLREKQQLPISQNKRYIARDGLPVLLPSNPAALLTSNILSAKSKLQIMLEPFLWRKH
184 hemG                    EIASYLASELKELG...................................................IQ...
232 gi_677962583_gb_KFU     EIASYLASELKEMG...................................................IW...
233 gi_780043845_WP_045     EIAEYLASELKELG...................................................VW...
234 gi_757780254_WP_042     EIAAYLASELKELG...................................................VC...
235 gi_391303361_gb_EIQ     EIAEYLASELKELG...................................................VW...
236 gi_489925542_WP_003     EIAEYLASELKELG...................................................VW...
237 gi_489107987_WP_003     EIAEYLASELKELG...................................................VW...
238 gi_353612405_gb_EHC     EIASYLASELKEMG...................................................IW...
239 gi_489937947_WP_003     EIAEYLASELKELG...................................................VW...
240 gi_749607088_WP_040     EIAEYLASELKELG...................................................VW...
241 gi_696370724_WP_032     EIAEYLASELKELG...................................................VW...
242 gi_721586509_gb_KGZ     EIAEYLASELKELG...................................................VW...
243 gi_757801814_WP_043     EIAEYLASELKELG...................................................VW...
244 gi_507084406_WP_016     EIAEYLASELKELG...................................................VW...
245 gi_817120192_WP_046     EIAAYLASELKELG...................................................IS...
246 gi_496062597_WP_008     EIAEYLASELKELG...................................................VW...
247 gi_507087120_WP_016     EIAEYLASELKELG...................................................VW...
248 gi_740849175_WP_038     EIAEYLASELKELG...................................................VW...
249 gi_446981838_WP_001     EIASYLASELKEMG...................................................IW...
250 gi_493736907_WP_006     EIAEYLASELKELG...................................................VW...
251 gi_685253248_WP_031     EIASYLASELKEMG...................................................IW...
252 gi_772672412_WP_045     EIAAYLASELKELG...................................................IY...
253 gi_640460605_WP_024     EIAAYLASELKELG...................................................IY...
254 gi_695718339_WP_032     EIAAYLASELKELG...................................................IY...
255 gi_779819602_WP_045     EIAAYLASELKELG...................................................IY...
256 gi_647320203_WP_025     EIAAYLASELKELG...................................................IY...
257 gi_798942147_WP_045     EIAAYLASELKELG...................................................IY...
258 gi_504646581_WP_014     EIASYLASELKELG...................................................IY...
259 gi_504698508_WP_014     EIAAYLASELKELG...................................................IY...
260 gi_495776931_WP_008     EIAAYLASELKELG...................................................IY...
261 gi_556497388_WP_023     EIAAYLASELKELG...................................................IY...
262 gi_556474668_WP_023     EIAAYLASELKELG...................................................IY...
263 gi_503838244_WP_014     EIASYLASELKELG...................................................VY...
264 gi_502864250_WP_013     EIASYLASELQELG...................................................IY...
265 gi_779900435_WP_045     EIAAYLASELKELG...................................................IY...
266 gi_779803830_WP_045     EIAAYLASELKELG...................................................IY...
267 gi_772702242_WP_045     EIASYLASELQELG...................................................IY...
268 gi_556485438_WP_023     EIAAYLASELKELG...................................................IY...
269 gi_654547061_WP_028     EIAAYLASELKELG...................................................IY...
270 gi_805302683_WP_046     EIAAYLASELKELG...................................................IY...
271 gi_527036124_WP_020     EIASYLASELKELG...................................................IY...
272 gi_695706440_WP_032     EIAAYLASELKELG...................................................IY...
273 gi_556479963_WP_023     EIAAYLASELKELG...................................................IY...
274 gi_654550469_WP_028     EIAAYLASELKELG...................................................IY...
    Consensus               EIA YLASELKELG                                                   I
```

Figure 4b continued

```
SEQ ID NO:                                            150       160       170       180       190       200       210
322 PPO2_AMATU          NATELSDEHVQESVGEFFERHFGKEFVDYVIDPFVAGTCGGDPQSLSMHHTFPEVWNIEKRFGSVFAGLI
184 hemG                ...........................................ADVANVHRIKEPQW...ENYDRVVIG..
232 gi_677962583_gb_KFU ...........................................ADVVNLHRAEELDW...DSYDRVVIG..
233 gi_780043845_WP_045 ...........................................ADVVNLHRTEEPDW...KNYDSVVIG..
234 gi_757780254_WP_042 ...........................................TDVVNLHRTEEPDW...ERYDRVVIG..
235 gi_391303361_gb_EIQ ...........................................ADVMNLHRTEEPEW...KNYDSVVIG..
236 gi_489925542_WP_003 ...........................................ADVVNLHRTAEPDW...QNYDSVVIG..
237 gi_489107987_WP_003 ...........................................ADVVNLHRTAEPDW...QNYDSVVIG..
238 gi_353612405_gb_EHC ...........................................ADVVNLHRASEPDW...DSYDRVVIG..
239 gi_489937947_WP_003 ...........................................ADVVNLHRTAEPDW...QNYDSVVIG..
240 gi_749607088_WP_040 ...........................................ADVLNLHRTAEPDW...QNYDSVVIG..
241 gi_696370724_WP_032 ...........................................ADVVNLHRTAEPDW...QNYDSVVIG..
242 gi_721586509_gb_KGZ ...........................................ADVVNLHRTAEPDW...QNYDSVVIG..
243 gi_757801814_WP_043 ...........................................ADVVNLHRTAEPDW...QNYDSVVVG..
244 gi_507084406_WP_016 ...........................................ADVVNLHRTAEPDW...QNYDSVVIG..
245 gi_817120192_WP_046 ...........................................TDVVNLHRTDEPDW...ERYDRVVIG..
246 gi_496062597_WP_008 ...........................................ADVVNLHRTAEPDW...QNYDSVVIG..
247 gi_507087120_WP_016 ...........................................ADVVNLHRTAEPDW...QHYDSVVIG..
248 gi_740849175_WP_038 ...........................................TDVVNLHRTAEPDW...QNYDSVVIG..
249 gi_446981838_WP_001 ...........................................ADVVNLHRAEEPDW...DSYDRVVIG..
250 gi_493736907_WP_006 ...........................................TDVVNLHRTAEPDW...KNYDSVVIG..
251 gi_685253248_WP_031 ...........................................ADVVNLHRAEEPDW...DSYDRVVIG..
252 gi_772672412_WP_045 ...........................................SDVVNLNRAEQIAW...QDYDRVVIG..
253 gi_640460605_WP_024 ...........................................SDVVNLNRVEQISW...QDYDRVVIG..
254 gi_695718339_WP_032 ...........................................SDVVNLNRAEQISW...QDYDRVVIG..
255 gi_779819602_WP_045 ...........................................SDVVNLNRASQIAW...QDYDRVVIG..
256 gi_647320203_WP_025 ...........................................SDVVNLNRAEQIAW...QDYDRVVIG..
257 gi_798942147_WP_045 ...........................................SDVVNLNRADQITW...QDYDRVVIG..
258 gi_504646581_WP_014 ...........................................SDVVNLNRTEQITW...QDYDRVVIG..
259 gi_504698508_WP_014 ...........................................SDVVNLNRAEQITW...QEYDRVVIG..
260 gi_495776931_WP_008 ...........................................SDVVNLNRASQIAW...QDYDRVVIG..
261 gi_556497388_WP_023 ...........................................SDVVNLNRAEQIAW...QDYDRVVIG..
262 gi_556474668_WP_023 ...........................................SDVVNLNRAEQIAW...QDYDRVVIG..
263 gi_503838244_WP_014 ...........................................ADVVNLNRTEEISW...QDYDRVVIG..
264 gi_502864250_WP_013 ...........................................SDVVNLNRTEQIAW...QDYDRVVIG..
265 gi_779900435_WP_045 ...........................................SDVVNLNRAEQIAW...HDYDRVVIG..
266 gi_779803830_WP_045 ...........................................SDVVNLNRAEQIAW...QDYDRVVIG..
267 gi_772702242_WP_045 ...........................................SDVVNLNRTEQIAW...QDYDRVVIG..
268 gi_556485438_WP_023 ...........................................SDVVNLNRAEQIAW...QEYDRVVIG..
269 gi_654547061_WP_028 ...........................................SDVVNLNRAEEIAW...QEYDRVVIG..
270 gi_805302683_WP_046 ...........................................SDVVNLNRAEQIAW...QDYDRVVIG..
271 gi_527036124_WP_020 ...........................................SDVVNLNRTEQIAW...QDYDRVVIG..
272 gi_695706440_WP_032 ...........................................SDVVNLNRASQIAW...QEYDRVVIG..
273 gi_556479963_WP_023 ...........................................SDVVNLNRAEQITW...QEYDRVVIG..
274 gi_654550469_WP_028 ...........................................SDVVNLNRVGQITW...QDYDRVVIG..
    Consensus                                                     DVVNL R E    W   Q YDRVVIG
```

Figure 4b continued

```
SEQ ID NO:                          220        230        240        250        260        270        280
322 PPO2_AMATU           QSTLLSKKEKGGENASIKKPRVRGSFSFQGGMQTLVDTMCKQLGEDELKLQCEVLSLSYNQKGIPSLGNW
184 hemG                 ..............ASIRYGH......YHSAFQEFVKKHATRL..................NSMPS.AFY
232 gi_677962583_gb_KFU  ..............ASIRYGH......YHSSFQEFVKKYATRL..................NGMPS.AFY
233 gi_780043845_WP_045  ..............ASIRYGH......YHTAFQEFVKKHATRL..................NAMPS.AFY
234 gi_757780254_WP_042  ..............ASIRYGH......YHSAFLEFVKKHATRL..................NHMPS.AFY
235 gi_391303361_gb_EIQ  ..............ASIRYGH......YHSAFQEFVKKHATQL..................NTMPS.AFY
236 gi_489925542_WP_003  ..............ASIRYGH......YHAAFQEFVKKHATRL..................NSMPS.AFY
237 gi_489107987_WP_003  ..............ASIRYGH......YHAAFQEFVKKHATRL..................NSMPS.AFY
238 gi_353612405_gb_EHC  ..............ASIRYGH......YHSAFQEFVKKYATRL..................NGMPS.AFY
239 gi_489937947_WP_003  ..............ASIRYGH......YHAAFQEFVKKHATRL..................NSMPS.AFY
240 gi_749607088_WP_040  ..............ASIRYGH......YHAAFQEFVKKHATRL..................NAMPS.AFY
241 gi_696370724_WP_032  ..............ASIRYGH......YHAAFQEFVKKHATRL..................NSMPS.AFY
242 gi_721586509_gb_KGZ  ..............ASIRYGH......YHAAFQEFVKKHATRL..................NAMPS.AFY
243 gi_757801814_WP_043  ..............ASIRYGH......YHAAFQEFVKKHATRL..................NAMPS.AFY
244 gi_507084406_WP_016  ..............ASIRYGH......YHAAFQEFVKKHATRL..................NAMPS.AFY
245 gi_817120192_WP_046  ..............ASIRYGH......YHSAFLAFVKKHATRL..................NRMPS.AFY
246 gi_496062597_WP_008  ..............ASIRYGH......YHAAFQEFVKKYATRL..................NSMPS.AFY
247 gi_507087120_WP_016  ..............ASIRYGH......YHAAFQEFVKKHATRL..................NAMPS.AFY
248 gi_740849175_WP_038  ..............ASIRYGH......YHAAFQEFVKKHATRL..................NAMPS.AFY
249 gi_446981838_WP_001  ..............ASIRYGH......YHSAFQEFVKKYATRL..................NGMPS.AFY
250 gi_493736907_WP_006  ..............ASIRYGH......YHSAFQEFVKKYATRL..................NAMPS.AFY
251 gi_685253248_WP_031  ..............ASIRYGH......YHSAFQEFVKKYATRL..................NGMPS.AFY
252 gi_772672412_WP_045  ..............ASIRYGH......FHPALDRFVKKHTAVL..................NKLPG.AFY
253 gi_640460605_WP_024  ..............ASIRYGH......FHPALDRFVKKHTAVL..................NKLPG.AFY
254 gi_695718339_WP_032  ..............ASIRYGH......FHPALDRFVKKHTAVL..................NKLPG.AFY
255 gi_779819602_WP_045  ..............ASIRYGH......FHPALDRFVKKHAAVL..................NKMPG.AFY
256 gi_647320203_WP_025  ..............ASIRYGH......FHPALDRFVKKHTAVL..................NKLPG.AFY
257 gi_798942147_WP_045  ..............ASIRYGH......FHPALDRFVKKHTAKL..................NTLPG.AFY
258 gi_504646581_WP_014  ..............ASIRYGH......FHPALDRFVKKHTAVL..................NKLPG.AFY
259 gi_504698508_WP_014  ..............ASIRYGH......FHPALDRFVKKHTAVL..................NKLPG.AFY
260 gi_495776931_WP_008  ..............ASIRYGH......FHPALDRFVKKHTAVL..................NKMPG.AFY
261 gi_556497388_WP_023  ..............ASIRYGH......FHPALDRFVKKHTAIL..................NKMPG.AFY
262 gi_556474668_WP_023  ..............ASIRYGH......FHPALDRFVKKHTAVL..................NKMPG.AFY
263 gi_503838244_WP_014  ..............ASIRYGH......FHPALDSFVKKHTAVL..................NALPG.AFY
264 gi_502864250_WP_013  ..............ASIRYGH......FHPALDRFVKKHTAAL..................NKLPG.AFY
265 gi_779900435_WP_045  ..............ASIRYGH......FHPALDRFVKKHTAVL..................NKMPG.AFY
266 gi_779803830_WP_045  ..............ASIRYGH......FHPALDRFVKKHTAKL..................NALPG.AFY
267 gi_772702242_WP_045  ..............ASIRYGH......FHPALDRFVKKHTAAL..................NKLPG.AFY
268 gi_556485438_WP_023  ..............ASIRYGH......FHPALDRFVKKHTAVL..................NKLPG.AFY
269 gi_654547061_WP_028  ..............ASIRYGH......FHPALDRFVKKHTAVL..................NTLPG.AFY
270 gi_805302683_WP_046  ..............ASIRYGH......FHPALDRFVKKHTAVL..................NKMPG.AFY
271 gi_527036124_WP_020  ..............ASIRYGH......FHPALDRFVKKHTAVL..................NKLPG.AFY
272 gi_695706440_WP_032  ..............ASIRYGH......FHPALDRFVKKHTAVL..................NKLPG.AFY
273 gi_556479963_WP_023  ..............ASIRYGH......FHPALVRFVKKHTAVL..................NKLPG.AFY
274 gi_654550469_WP_028  ..............ASIRYGH......FHPALDRFVKKHTAVL..................NKLPG.AFY
    Consensus                          ASIRYGH       H A   FVKKH   L                  N MP  AFY
```

Figure 4b continued

```
SEQ ID NO:                                   290       300       310       320       330       340       350
322 PPO2_AMATU             SVSSMSNNTSEDQSYDAVWVTAPIRNVKEMKIMKFGNPFSLDFIPEVTYVPLSVMITAFKKCKVKRPLEG
184 hemG                   SVN..............LVARKPEKRTPQT.....NSYARKFL.........MNSQWRPDRS......
232 gi_677962583_gb_KFU    SVN..............LVARKAEKRTPQT.....NSYARKFL.........MSSPWRPDYC......
233 gi_780043845_WP_045    SVN..............LVARKPEKRTPQT.....NSYARKFL.........MSSPWRPDRS......
234 gi_757780254_WP_042    SVN..............LVARKPEKRTPQT.....NSYARKFL.........MNSQWRPDRS......
235 gi_391303361_gb_EIQ    SVN..............LVARKPEKRTPQT.....NSYARKFL.........MSSPWRPDHS......
236 gi_489925542_WP_003    SVN..............LVARKPEKRTPQT.....NSYARKFL.........MSSPWRPDHS......
237 gi_489107987_WP_003    SVN..............LVARKPEKRTPQT.....NSYARKFL.........MSSPWRPDHS......
238 gi_353612405_gb_EHC    SVN..............LVARKAEKRTPQT.....NSYARKFL.........MSSPWRPDYC......
239 gi_489937947_WP_003    SVN..............LVARKPEKRTPQT.....NSYARKFL.........MGSPWRPDHS......
240 gi_749607088_WP_040    SVN..............LVARKPEKRTPQT.....NSYARKFL.........MSSPWRPDRS......
241 gi_696370724_WP_032    SVN..............LVARKPEKRTPQT.....NSYARKFL.........MSSPWRPDHS......
242 gi_721586509_gb_KGZ    SVN..............LVARKPEKRTPQT.....NSYARKFL.........MSSPWRPDRS......
243 gi_757801814_WP_043    SVN..............LVARKPEKRTPQT.....NSYARKFL.........MSSPWRPDRS......
244 gi_507084406_WP_016    SVN..............LVARKPEKRTPQT.....NSYARKFL.........MSSPWRPDRS......
245 gi_817120192_WP_046    SVN..............LVARKPEKRTPQT.....NSYARKFL.........MNSQWRPDRS......
246 gi_496062597_WP_008    SVN..............LVARKPEKRTPQT.....NSYARKFL.........MSSPWRPDHS......
247 gi_507087120_WP_016    SVN..............LVARKPEKRTPQT.....NSYARKFL.........MSSPWRPDRS......
248 gi_740849175_WP_038    SVN..............LVARKPEKRTPQT.....NSYARKFL.........MSSPWRPDRS......
249 gi_446981838_WP_001    SVN..............LVARKAEKRTPQT.....NSYARKFL.........MSSPWRPDYC......
250 gi_493736907_WP_006    SVN..............LVARKPEKRTPQT.....NSYARKFL.........MSSPWRPDRS......
251 gi_685253248_WP_031    SVN..............LVARKAEKRTPQT.....NSYARKFL.........MSSPWRPDYC......
252 gi_772672412_WP_045    SVN..............LVARKAEKRTPQT.....NSYTRKFL.........LNSPWQPDLC......
253 gi_640460605_WP_024    SVN..............LVARKPEKRTPQT.....NSYTRKFL.........LSSPWQPELC......
254 gi_695718339_WP_032    SVN..............LVARKPEKRTPQT.....NSYTRKFL.........LNSPWQPDLC......
255 gi_779819602_WP_045    SVN..............LVARKAEKRTPQT.....NSYTRKFL.........LSSPWQPDLC......
256 gi_647320203_WP_025    SVN..............LVARKAEKRTPQT.....NSYTRKFL.........LNSPWQPDLC......
257 gi_798942147_WP_045    SVN..............LVARKPEKRTPQT.....NSYTRKFL.........LNSPWQPELC......
258 gi_504646581_WP_014    SVN..............LVARKAEKRTPQT.....NSYTRKFL.........LNSPWRPDLC......
259 gi_504698508_WP_014    SVN..............LVARKAEKRTPQT.....NSYTRKFL.........LSSPWQPDLC......
260 gi_495776931_WP_008    SVN..............LVARKAEKRTPQT.....NSYTRKFL.........LSSPWQPDLC......
261 gi_556497388_WP_023    SVN..............LVARKAEKRTPQT.....NSYTRKFL.........LSSPWQPDLC......
262 gi_556474668_WP_023    SVN..............LVARKAEKRTPQT.....NSYTRKFL.........LSSPWQPDLC......
263 gi_503838244_WP_014    SVN..............LVARKAEKRTPQT.....NSYTRKFL.........LGSPWQPDLC......
264 gi_502864250_WP_013    SVN..............LVARKPEKRTPQT.....NSYTRKFL.........LNSPWQPDLC......
265 gi_779900435_WP_045    SVN..............LVARKAEKRTPQT.....NSYTRKFL.........LSSPWQPDLC......
266 gi_779803830_WP_045    SVN..............LVARKAEKRTPQT.....NSYTRKFL.........LSSPWQPDLC......
267 gi_772702242_WP_045    SVN..............LVARKPEKRTPQT.....NSYTRKFL.........LNSPWQPDLC......
268 gi_556485438_WP_023    SVN..............LVARKAEKRTPQT.....NSYTRKFL.........LSSPWQPDLC......
269 gi_654547061_WP_028    SVN..............LVARKAEKRTPQT.....NSYTRKFL.........LGSPWQPDLC......
270 gi_805302683_WP_046    SVN..............LVARKAEKRTPQT.....NSYTRKFL.........LSSPWQPDLC......
271 gi_527036124_WP_020    SVN..............LVARKPEKRTPQT.....NSYTRKFL.........LSSPWQPDIS......
272 gi_695706440_WP_032    SVN..............LVARKAEKRTPQT.....NSYTRKFL.........LGSPWQPDLC......
273 gi_556479963_WP_023    SVN..............LVARKAEKRTPQT.....NSYTRKFL.........LSSPWQPALC......
274 gi_654550469_WP_028    SVN..............LVARKAEKRTPQT.....NSYTRKFL.........LNSPWQPDLC......
    Consensus              SVN              LVARK EKRTPQT     NSY RKFL          SSPW PD C
```

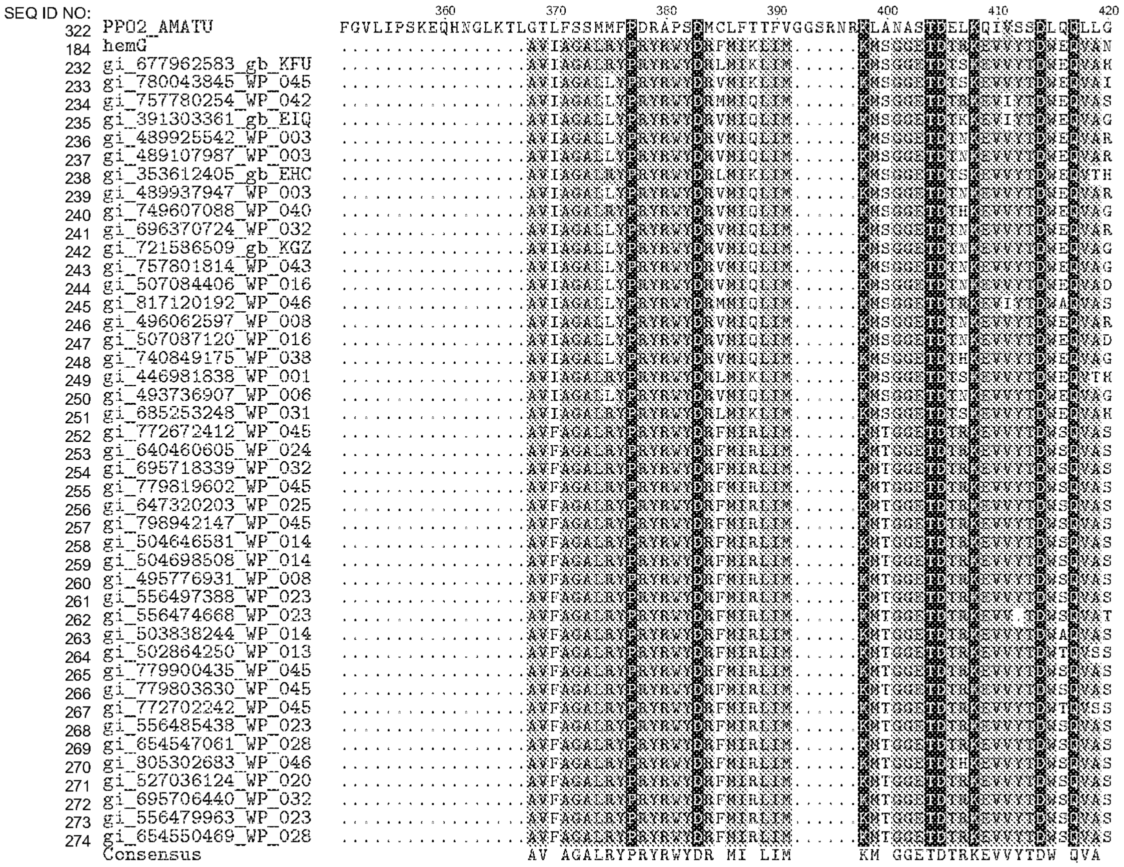

Figure 4b continued

| SEQ ID NO: | | 360 370 380 390 400 410 420 |
|---|---|---|
| 322 | PPO2_AMATU | FGVLIPSKEQHNGLKTLGTLFSSMMFSDRAPSEMCLFTTFVGGSRNRELANASESELEQIESSELQELLG |
| 184 | hemG | ................XVIAGALRYERYRWEDRFMEKEIM.....ESSSEIDTSEVVYEDWEREN |
| 232 | gi_677962583_gb_KFU | ................XVIAGALRYERYRWEDRLMEKEIM.....ESSSEIDTSEVVYEDWEREH |
| 233 | gi_780043845_WP_045 | ................XVIAGALRYERYRWEDRVMEQELIM.....ESSSEIDTSEVVYEDWEREI |
| 234 | gi_757780254_WP_042 | ................XVIAGALRYERYRWEDRMMEQEIM.....ESSSEIDTEVIYEDWEAES |
| 235 | gi_391303361_gb_EIQ | ................XVIAGALRYERYRWEDRVMEQELIM.....ESSSEIDTEVVYEDWEREG |
| 236 | gi_489925542_WP_003 | ................XVIAGALRYERYRWEDRVMEQELIM.....ESSSEIDTEVVYEDWEREG |
| 237 | gi_489107987_WP_003 | ................XVIAGALRYERYRWEDRVMEQELIM.....ESSSEIDTEVVYEDWEREG |
| 238 | gi_353612405_gb_EHC | ................XVIAGALRYERYRWEDRLMEKEIM.....ESSSEIDTSEVVYEDWERTH |
| 239 | gi_489937947_WP_003 | ................XVIAGALRYERYRWEDRVMEQELIM.....ESSSEIDTEVVYEDWEREG |
| 240 | gi_749607088_WP_040 | ................XVIAGALRYERYRWEDRVMEQELIM.....ESSSEIDTEVVYEDWEREG |
| 241 | gi_696370724_WP_032 | ................XVIAGALRYERYRWEDRVMEQELIM.....ESSSEIDTEVVYEDWEREG |
| 242 | gi_721586509_gb_KGZ | ................XVIAGALRYERYRWEDRVMEQELIM.....ESSSEIDTEVVYEDWEREG |
| 243 | gi_757801814_WP_043 | ................XVIAGALRYERYRWEDRVMEQELIM.....ESSSEIDTEVVYEDWEREG |
| 244 | gi_507084406_WP_016 | ................XVIAGALRYERYRWEDRVMEQELIM.....ESSSEIDTEVVYEDWERED |
| 245 | gi_817120192_WP_046 | ................XVIAGALRYERYRWEDRMMEQEIM.....ESSSEIDTEVIYEDWEAES |
| 246 | gi_496062597_WP_008 | ................XVIAGALRYERYRWEDRVMEQELIM.....ESSSEIDTEVVYEDWEREG |
| 247 | gi_507087120_WP_016 | ................XVIAGALRYERYRWEDRVMEQELIM.....ESSSEIDTEVVYEDWERED |
| 248 | gi_740849175_WP_038 | ................XVIAGALRYERYRWEDRVMEQELIM.....ESSSEIDTEVVYEDWEREG |
| 249 | gi_446981838_WP_001 | ................XVIAGALRYERYRWEDRLMEKEIM.....ESSSEIDTSEVVYEDWERTH |
| 250 | gi_493736907_WP_006 | ................XVIAGALRYERYRWEDRLMEKEIM.....ESSSEIDTSEVVYEDWEREH |
| 251 | gi_685253248_WP_031 | ................XVIAGALRYERYRWEDRLMEKEIM.....ESSSEIDTSEVVYEDWEREH |
| 252 | gi_772672412_WP_045 | ................XVFAGALRYERYRWEDRFMERELIM.....ETSSEIDTEVVYEDWESES |
| 253 | gi_640460605_WP_024 | ................XVFAGALRYERYRWEDRFMERELIM.....ETSSEIDTEVVYEDWESES |
| 254 | gi_695718339_WP_032 | ................XVFAGALRYERYRWEDRFMERELIM.....ETSSEIDTEVVYEDWESES |
| 255 | gi_779819602_WP_045 | ................XVFAGALRYERYRWEDRFMERELIM.....ETSSEIDTEVVYEDWESES |
| 256 | gi_647320203_WP_025 | ................XVFAGALRYERYRWEDRFMERELIM.....ETSSEIDTEVVYEDWESES |
| 257 | gi_798942147_WP_045 | ................XVFAGALRYERYRWEDRFMERELIM.....ETSSEIDTEVVYEDWESES |
| 258 | gi_504646581_WP_014 | ................XVFAGALRYERYRWEDRFMERELIM.....ETSSEIDTEVVYEDWESES |
| 259 | gi_504698508_WP_014 | ................XVFAGALRYERYRWEDRFMERELIM.....ETSSEIDTEVVYEDWESES |
| 260 | gi_495776931_WP_008 | ................XVFAGALRYERYRWEDRFMERELIM.....ETSSEIDTEVVYEDWESES |
| 261 | gi_556497388_WP_023 | ................XVFAGALRYERYRWEDRFMERELIM.....ETSSEIDTEVVYEDWESES |
| 262 | gi_556474668_WP_023 | ................XVFAGALRYERYRWEDRFMERELIM.....ETSSEIDTEVVYEDWESET |
| 263 | gi_503838244_WP_014 | ................XVFAGALRYERYRWEDRFMERELIM.....ETSSEIDTEVVYEDWEAES |
| 264 | gi_502864250_WP_013 | ................XVFAGALRYERYRWEDRFMERELIM.....ETSSEIDTEVVYEDWETSS |
| 265 | gi_779900435_WP_045 | ................XVFAGALRYERYRWEDRFMERELIM.....ETSSEIDTEVVYEDWESES |
| 266 | gi_779803830_WP_045 | ................XVFAGALRYERYRWEDRFMERELIM.....ETSSEIDTEVVYEDWESES |
| 267 | gi_772702242_WP_045 | ................XVFAGALRYERYRWEDRFMERELIM.....ETSSEIDTEVVYEDWESES |
| 268 | gi_556485438_WP_023 | ................XVFAGALRYERYRWEDRFMERELIM.....ETSSEIDTEVVYEDWESES |
| 269 | gi_654547061_WP_028 | ................XVFAGALRYERYRWEDRFMERELIM.....ETSSEIDTEVVYEDWESES |
| 270 | gi_305302683_WP_046 | ................XVFAGALRYERYRWEDRFMERELIM.....ETSSEIDTEVVYEDWESES |
| 271 | gi_527036124_WP_020 | ................XVFAGALRYERYRWEDRFMERELIM.....ETSSEIDTEVVYEDWESES |
| 272 | gi_695706440_WP_032 | ................XVFAGALRYERYRWEDRFMERELIM.....ETSSEIDTEVVYEDWESES |
| 273 | gi_556479963_WP_023 | ................XVFAGALRYERYRWEDRFMERELIM.....ETSSEIDTEVVYEDWESES |
| 274 | gi_654550469_WP_028 | ................XVFAGALRYERYRWEDRFMERELIM.....ETSSEIDTEVVYEDWESES |
| | Consensus | AV AGALRYPRYRWYDR MI LIM KM GGETDTRKEVVYTDW QVA |

Figure 4b continued

```
SEQ ID NO:                                  430       440       450       460       470       480       490
322 PPO2_AMATU             TEDEPSFVNHLFWSNAFPLYGHNYDSVLRAIDKMEKDLPGFFYAGNHKGGLSVGKAMASGCKAAELVISY
184 hemG                   FARE...............................................................IAH
232 gi_677962583_gb_KFU    FARE...............................................................IAH
233 gi_780043845_WP_045    FARE...............................................................IAQ
234 gi_757780254_WP_042    FARE...............................................................IAQ
235 gi_391303361_gb_EIQ    FARE...............................................................IAQ
236 gi_489925542_WP_003    FARE...............................................................IAQ
237 gi_489107987_WP_003    FARE...............................................................IAQ
238 gi_353612405_gb_EHC    FARE...............................................................IAH
239 gi_489937947_WP_003    FARE...............................................................IAQ
240 gi_749607088_WP_040    FARE...............................................................IAQ
241 gi_696370724_WP_032    FARE...............................................................IAQ
242 gi_721586509_gb_KGZ    FARE...............................................................IAQ
243 gi_757801814_WP_043    FARE...............................................................IAQ
244 gi_507084406_WP_016    FARE...............................................................IAQ
245 gi_817120192_WP_046    FARE...............................................................IAQ
246 gi_496062597_WP_008    FARE...............................................................IAQ
247 gi_507087120_WP_016    FARE...............................................................IAQ
248 gi_740849175_WP_038    FARE...............................................................IAQ
249 gi_446981838_WP_001    FARE...............................................................IAH
250 gi_493736907_WP_006    FARE...............................................................IAQ
251 gi_685253248_WP_031    FARE...............................................................IAH
252 gi_772672412_WP_045    FARE...............................................................IAH
253 gi_640460605_WP_024    FARE...............................................................IAH
254 gi_695718339_WP_032    FARE...............................................................IAH
255 gi_779819602_WP_045    FARE...............................................................IAH
256 gi_647320203_WP_025    FARE...............................................................IAH
257 gi_798942147_WP_045    FARE...............................................................IAH
258 gi_504646581_WP_014    FARE...............................................................IAH
259 gi_504698508_WP_014    FARE...............................................................IAH
260 gi_495776931_WP_008    FARE...............................................................IAH
261 gi_556497388_WP_023    FARE...............................................................IAH
262 gi_556474668_WP_023    FARE...............................................................IAH
263 gi_503838244_WP_014    FARE...............................................................IAQ
264 gi_502864250_WP_013    FARE...............................................................IAH
265 gi_779900435_WP_045    FARE...............................................................IAH
266 gi_779803830_WP_045    FARE...............................................................IAH
267 gi_772702242_WP_045    FARD...............................................................IAH
268 gi_556485438_WP_023    FARE...............................................................IAH
269 gi_654547061_WP_028    FARE...............................................................IAH
270 gi_805302683_WP_046    FARE...............................................................IAH
271 gi_527036124_WP_020    FARE...............................................................IAH
272 gi_695706440_WP_032    FARE...............................................................IAH
273 gi_556479963_WP_023    FARE...............................................................IAH
274 gi_654550469_WP_028    FARE...............................................................IAH
    Consensus              FARE                                                               IAH
```

Figure 4b continued

| SEQ ID NO: | | 500 |
|---|---|---|
| 322 | PPO2_AMATU | LDSHIYVKMDEKTA |
| 184 | hemG | LTDKPTLK...... |
| 232 | gi_677962583_gb_KFU | LTNKSSAK...... |
| 233 | gi_780043845_WP_045 | LTNKALLK...... |
| 234 | gi_757780254_WP_042 | LTPDSVVK...... |
| 235 | gi_391303361_gb_EIQ | LTNKTLLK...... |
| 236 | gi_489925542_WP_003 | LTNKASLK...... |
| 237 | gi_489107987_WP_003 | LTNKTSLK...... |
| 238 | gi_353612405_gb_EHC | L............. |
| 239 | gi_489937947_WP_003 | LTNKTSLK...... |
| 240 | gi_749607088_WP_040 | LTHKTVSK...... |
| 241 | gi_696370724_WP_032 | LTNKALLK...... |
| 242 | gi_721586509_gb_KGZ | LTNKTLSK...... |
| 243 | gi_757801814_WP_043 | LTNKTLSK...... |
| 244 | gi_507084406_WP_016 | LTHKTLSK...... |
| 245 | gi_817120192_WP_046 | LTPDSLVK...... |
| 246 | gi_496062597_WP_008 | LTNKALLK...... |
| 247 | gi_507087120_WP_016 | LTHKTLSK...... |
| 248 | gi_740849175_WP_038 | LTHKTLPK...... |
| 249 | gi_446981838_WP_001 | LTNKSSAK...... |
| 250 | gi_493736907_WP_006 | LTHKTLPK...... |
| 251 | gi_685253248_WP_031 | LTNKSSAK...... |
| 252 | gi_772672412_WP_045 | LTDNSRLK...... |
| 253 | gi_640460605_WP_024 | LTDDSRHK...... |
| 254 | gi_695718339_WP_032 | LTGDSRHK...... |
| 255 | gi_779819602_WP_045 | LTGDSRLK...... |
| 256 | gi_647320203_WP_025 | LTGNSRLK...... |
| 257 | gi_798942147_WP_045 | LTGDSRHK...... |
| 258 | gi_504646581_WP_014 | LSRDSQRK...... |
| 259 | gi_504698508_WP_014 | LTDDSRLK...... |
| 260 | gi_495776931_WP_008 | LTGDSRLK...... |
| 261 | gi_556497388_WP_023 | LTGDSRLK...... |
| 262 | gi_556474668_WP_023 | LTGDSRLK...... |
| 263 | gi_503838244_WP_014 | LTADSKVK...... |
| 264 | gi_502864250_WP_013 | LSPESRRI...... |
| 265 | gi_779900435_WP_045 | LTGDSRLK...... |
| 266 | gi_779803830_WP_045 | LTGDSRHK...... |
| 267 | gi_772702242_WP_045 | LSPESRRI...... |
| 268 | gi_556485438_WP_023 | LTGDSRLK...... |
| 269 | gi_654547061_WP_028 | LAGDSRLK...... |
| 270 | gi_805302683_WP_046 | LTGDSRLK...... |
| 271 | gi_527036124_WP_020 | LSGDSRLK...... |
| 272 | gi_695706440_WP_032 | LTGDSRLK...... |
| 273 | gi_556479963_WP_023 | LTDDSRLK...... |
| 274 | gi_654550469_WP_028 | LSGDSRVK...... |
| | Consensus | LT S K |

X non conserved
X ≥ 50% conserved
X all match

Figure 5

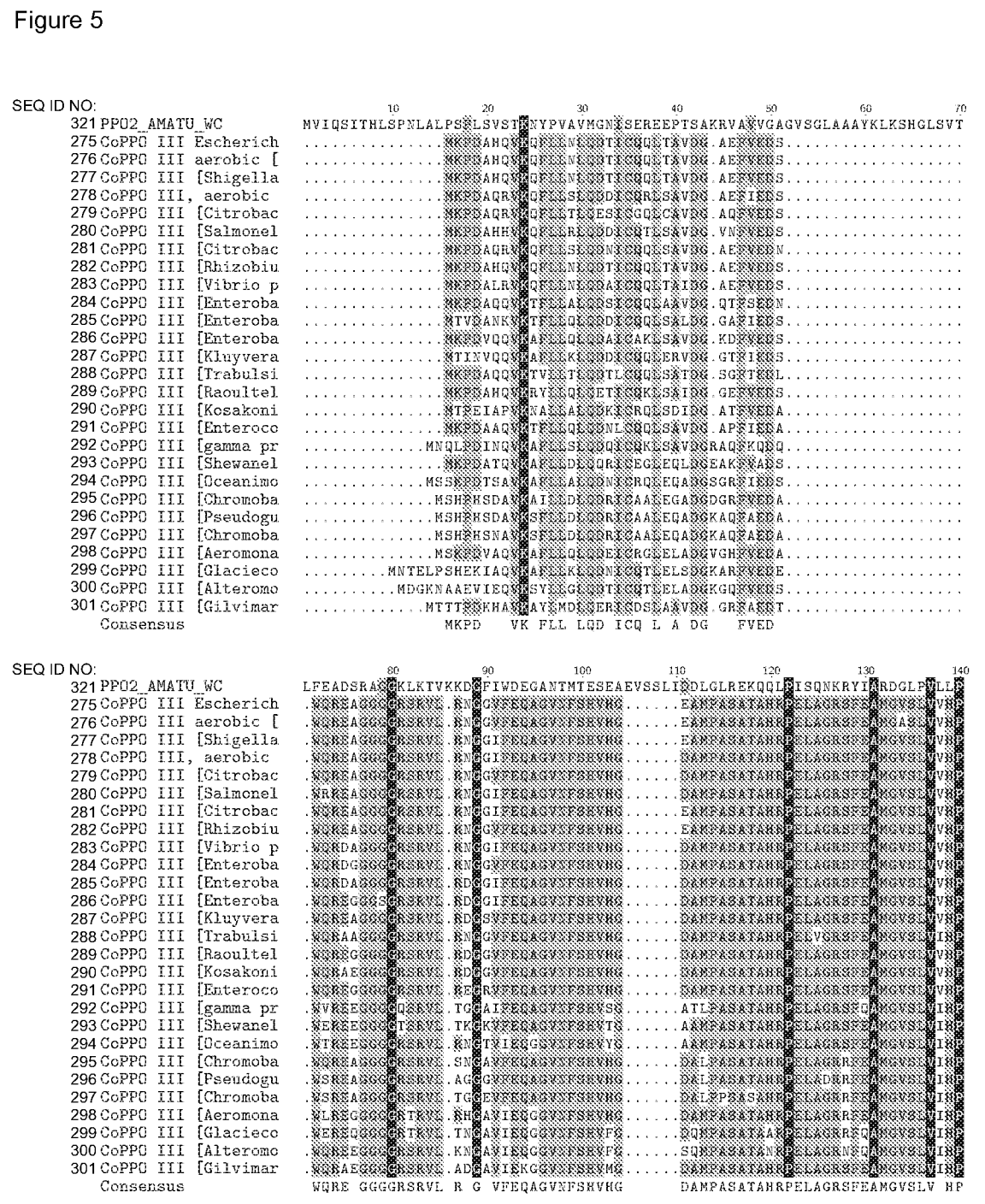

```
SEQ ID NO:                               10        20        30        40        50        60        70
321 PPO2_AMATU_WC          MVIQSITHLSPNLALPSSLSVSTKNYPVAVMGNISEREEPTSAKRVAYVGAGVSGLAAAYKLKSHGLSVT
275 CoPPO III Escherich    ...............MKPDAHQVKQFLLNLQDTICQQLTAVDG.AEFVEDS...................
276 CoPPO III aerobic [    ...............MKPDAHQVKQFLLNLQDTICQQLTAVDG.AEFVEDS...................
277 CoPPO III [Shigella    ...............MKPDAHQVKQFLLNLQDTICQQLTAVDG.AEFVEDS...................
278 CoPPO III, aerobic     ...............MKPDAQRVKQFLLSLQDDICQRLSAVDG.AEFIEDS...................
279 CoPPO III [Citrobac    ...............MKPDAQRVKQFLLTLQESICGQLCAVDG.AQFVEDS...................
280 CoPPO III [Salmonel    ...............MKPDAHHVKQFLLRLQDDICQTLSAVDG.VNFVEDS...................
281 CoPPO III [Citrobac    ...............MKPDAQRVKQFLLSLQDNICQQLSAVDG.AEFVEDN...................
282 CoPPO III [Rhizobiu    ...............MKPDAHQVKQFLLNLQDTICQQLTAVDG.AEFVEDS...................
283 CoPPO III [Vibrio p    ...............MKPDALRVKQFLLNLQDAICQQLTAIDG.AEFVEDS...................
284 CoPPO III [Enteroba    ...............MKPDAQQVKTFLLALQDSICQQLAAVDG.QTFSEDN...................
285 CoPPO III [Enteroba    ...............MTVDANKVKTFLLQLQDDICQQLSALDG.GAFIEDS...................
286 CoPPO III [Enteroba    ...............MKPDVQQVKAFLLQLQDAICAKLSAVDG.KDFVEDS...................
287 CoPPO III [Kluyvera    ...............MTINVQQVKAFLLKLQDDICQQLERVDG.GTFIEDS...................
288 CoPPO III [Trabulsi    ...............MKPDAQQVKTVLLTLQDTLCQQLSATDG.SGFTEDL...................
289 CoPPO III [Raoultel    ...............MKPDAHQVKRYLLQLQETICQKLSAIDG.GEFVEDS...................
290 CoPPO III [Kosakoni    ...............MTPEIAPVKNALLALQDKICRQLSDIDG.ATFVEDA...................
291 CoPPO III [Enteroco    ...............MKPDAAQVKTFLLQLQDNLCQQLSAVDG.APFIEDA...................
292 CoPPO III [gamma pr    .............MNQLPDINQVKAFLLSLQDQICQKLSAVDGRAQFKQDQ...................
293 CoPPO III [Shewanel    ...............MKPDATQVKAFLLDLQQRICEGLEQLDGEAKFVADS...................
294 CoPPO III [Oceanimo    .............MSSKPDTSAVKAFLLALQDNICRQLEQADGSGRFIEDS...................
295 CoPPO III [Chromoba    ..............MSHPHSDAVKAILLDLQDRICAALEGADGDGRFVEDA...................
296 CoPPO III [Pseudogu    ..............MSHPHSDAVKSFLLDLQDRICAALEQADGKAQFAEDA...................
297 CoPPO III [Chromoba    ..............MSHPHSNAVKSFLLDLQDRICAALEQADGKAQFAEDA...................
298 CoPPO III [Aeromona    ..............MSKPDVAQVKAFLLQLQDEICRGLELADGVGHFVEDA...................
299 CoPPO III [Glacieco    .........MNTELPSHEKIAQVKAFLLKLQDNICQTLELSDGKARFVEDE...................
300 CoPPO III [Alteromo    ..........MDGKNAAEVIEQVKSYLLGLQDTICQTLELADGKGQFVEDS...................
301 CoPPO III [Gilvimar    .............MTTTPDKHAVKAYLMDLQERICDSLAAVDG.GRFAEDT...................
    Consensus                             MKPD   VK FLL LQD ICQ L A DG   FVED

SEQ ID NO:                      80        90       100       110       120       130       140
321 PPO2_AMATU_WC          LFEADSRAGGKLKTVKKDGFIWDEGANTMTESEAEVSSLIQDLGLREKQQLPISQNKRYIARDGLPVLLP
275 CoPPO III Escherich    .WQREAGGGGRSRVL.RNGGVFEQAGVNFSHVHG......EAMPASATAHRPELAGRSFEAMGVSLVVHP
276 CoPPO III aerobic [    .WQREAGGGGRSRVL.RNGGVFEQAGVNFSHVHG......EAMPASATAHRPELAGRSFEAMGASLVVHP
277 CoPPO III [Shigella    .WQREAGGGGRSRVL.RNGGIFEQAGVNFSHVHG......EAMPASATAHRPELAGRSFEAMGVSLVVHP
278 CoPPO III, aerobic     .WQREAGGGGRSRVL.RNGGIFEQAGVNFSHVHG......DAMPASATAHRPELAGRSFEAMGVSLVVHP
279 CoPPO III [Citrobac    .WQREAGGGGRSRVL.RNGGVFEQAGVNFSHVHG......DAMPASATAHRPELAGRSFEAMGVSLVVHP
280 CoPPO III [Salmonel    .WRKEAGGGGRSRVL.RNGGIFEQAGVNFSHVHG......DAMPASATAHRPELAGRSFEAMGVSLVVHP
281 CoPPO III [Citrobac    .WQREAGGGGRSRVL.RNGGIFEQAGVNFSHVHG......EAMPASATAHRPELAGRSFEAMGVSLVVHP
282 CoPPO III [Rhizobiu    .WQREAGGGGRSRVL.RNGGVFEQAGVNFSHVHG......EAMPASATAHRPELAGRSFEAMGVSLVVHP
283 CoPPO III [Vibrio p    .WQRDAGGGGRSRVL.RNGGIFEQAGVNFSHVHG......DAMPASATAHRPELAGRSFEAMGVSLVVHP
284 CoPPO III [Enteroba    .WQRDGGGGGRSRVL.RNGGVFEQAGVNFSHVHG......DAMPASATAHRPELAGRSFEAMGVSLVVHP
285 CoPPO III [Enteroba    .WQRDAGGGGRSRVL.RDGGIFEQAGVNFSHVHG......DAMPASATAHRPELAGRSFEAMGVSLVVHP
286 CoPPO III [Enteroba    .WQREGGGSGRSRVL.RDGGIFEQAGVNFSHVHG......DAMPASATAHRPELAGRSFEAMGVSLVVHP
287 CoPPO III [Kluyvera    .WQREAGGGGRSRVL.RDGSVFEQAGVNFSHVHG......DAMPASATAHRPELAGRSFEAMGVSLVVHP
288 CoPPO III [Trabulsi    .WQRAAGGGGRSRVL.RNGGVFEQAGVNFSHVHG......DAMPASATAHRPELVGRSFEAMGVSLVIHP
289 CoPPO III [Raoultel    .WQREGGGGGRSRVL.RDGGVFEQAGVNFSHVHG......DAMPASATAHRPELAGRSFEAMGVSLVVHP
290 CoPPO III [Kosakoni    .WQRAEGGGGRSRVL.RDGGVFEQAGVNFSHVHG......DAMPASATAHRPELAGRSFEAMGVSLVVHP
291 CoPPO III [Enteroco    .WQREGGGGGRSRVL.REGRVFEQAGVNFSHVHG......DAMPASATAHRPELAGRSFEAMGVSLVVHP
292 CoPPO III [gamma pr    .WVKEEGGGGQSRVL.TGGAIFEQAGVNFSHVSG......ATLPASATAHRPELAGRSFQAMGVSLVIHP
293 CoPPO III [Shewanel    .WEKEEGGGGTSRVL.TKGKVFEQAGVNFSHVTG......AAMPASATAHRPELAGRSFEAMGVSLVIHP
294 CoPPO III [Oceanimo    .WTKEEGGGGRSRVL.RNGTVIEQGGVNFSHVYG......AAMPASATAHRPELAGRSFEAMGVSLVIHP
295 CoPPO III [Chromoba    .WQREAGGGGRSRVL.SNGAVFEQAGVNFSHVHG......DALPASATAHRPELAGRRFEAMGVSLVIHP
296 CoPPO III [Pseudogu    .WSREAGGGGRSRVL.AGGGVFEQAGVNFSHVHG......DALPASATAHRPELADRRFEAMGVSLVIHP
297 CoPPO III [Chromoba    .WSREAGGGGRSRVL.TGGEVFEQAGVNFSHVHG......DALPPSASAHRPELAGRRFEAMGVSLVIHP
298 CoPPO III [Aeromona    .WLREGGGGGRTRVL.RHGAVIEQGGVNFSHVHG......DAMPASATAHRPELAGRRFEAMGVSLVIHP
299 CoPPO III [Glacieco    .WEREQGGGGRTRVL.TNGAVIEQGGVNFSHVFG......DQMPASATAAKPELAGRRFQAMGVSLVIHP
300 CoPPO III [Alteromo    .WQREEGGGGRSRVL.KNGAVIEQGGVNFSHVFG......SQMPASATANRPELAGRNFQAMGVSLVIHP
301 CoPPO III [Gilvimar    .WQRAEGGGGRSRVL.ADGAVIEKGGVNFSHVMG......DAMPASATAHRPELAGRSFEAMGVSLVIHP
    Consensus               WQRE GGGGRSRVL R G VFEQAGVNFSHVHG      DAMPASATAHRPELAGRSFEAMGVSLV HP
```

Figure 5 continued

```
SEQ ID NO:                       150       160       170       180       190       200       210
321 PPO2_AMATU_WC         SNPAALLTSNILSAKSKLQIMLEPFLWRKHNATELSDEHVQESVGEFFERHFGKEFVDYVIDPFVAGTCG
275 CoPPO III Escherich   HN.....................PYVPTSHANVRF............................FIAEKPG
276 CoPPO III aerobic [   HN.....................PYVPTSHANVRF............................FIAEKPG
277 CoPPO III [Shigella   HN.....................PYVPTSHANVRF............................FIAEKPG
278 CoPPO III, aerobic    LN.....................PYIPTSHANVRF............................FIAEKPG
279 CoPPO III [Citrobac   LN.....................PYIPTSHANVRF............................FIAEKPG
280 CoPPO III [Salmonel   HN.....................PYIPTSHANVRF............................FIAEKPG
281 CoPPO III [Citrobac   QN.....................PYIPTSHANVRF............................FIAEKPG
282 CoPPO III [Rhizobiu   HN.....................PYVPTSHANVRF............................FIAEKPG
283 CoPPO III [Vibrio p   LN.....................PYIPTSHANVRF............................FIAEKPD
284 CoPPO III [Enteroba   HN.....................PYVPTSHANVRF............................FIAEKPG
285 CoPPO III [Enteroba   RN.....................PYVPTSHANVRF............................FIAEKPG
286 CoPPO III [Enteroba   RN.....................PYVPTSHANVRF............................FIAEKPG
287 CoPPO III [Kluyvera   RN.....................PYVPTSHANVRF............................FIAEKPG
288 CoPPO III [Trabulsi   HN.....................PYVPTSHANVRF............................FIAEKPG
289 CoPPO III [Raoultel   WN.....................PYVPTSHANVRF............................FIAEKPG
290 CoPPO III [Kosakoni   RN.....................PYVPTSHANVRF............................FIAQKPG
291 CoPPO III [Enteroco   LN.....................PYVPTSHANVRF............................FIAEKPG
292 CoPPO III [gamma pr   LS.....................PYIPTSHANVRF............................FIAEKPG
293 CoPPO III [Shewanel   NN.....................PYVPTTHANVRF............................FIAEKEG
294 CoPPO III [Oceanimo   HN.....................PHVPTSHANVRF............................FIAEKEG
295 CoPPO III [Chromoba   HN.....................PHVPTSHANVRF............................FIAEKAG
296 CoPPO III [Pseudogu   SN.....................PHVPTSHANVRF............................FIAEKDG
297 CoPPO III [Chromoba   SN.....................PHVPTSHANVRF............................FIAEKDG
298 CoPPO III [Aeromona   HN.....................PYVPTSHANVRF............................FIAEKEG
299 CoPPO III [Glacieco   HN.....................PYIPTSHANVRF............................FIAEKEG
300 CoPPO III [Alteromo   HN.....................PYIPTSHANVRF............................FIAEKEG
301 CoPPO III [Gilvimar   AN.....................PYAPTSHANVRF............................FIAEKEG
    Consensus              N                     PYVPTSHANVRF                            FIAEKPG

SEQ ID NO:                       220       230       240       250       260       270       280
321 PPO2_AMATU_WC         GDPQSLSMHHTFPEVWNIEKRFGSVFAGLIQSTLLSKKEKGGENASIKKPRVRGSFSFQGGM...QTLVD
275 CoPPO III Escherich   ADP...........VW....WFGGGFD........................LTPFYGFEEDAIHWHRTAR
276 CoPPO III aerobic [   ADP...........VW....WFGGGFD........................LTPFYGFEEDAIHWHRTAR
277 CoPPO III [Shigella   AEP...........VW....WFGGGFD........................LTPFYGFEEDAIHWHRTAR
278 CoPPO III, aerobic    ADP...........VW....WFGGGFD........................LTPYYGIEEDAVHWHRTAR
279 CoPPO III [Citrobac   ADP...........VW....WFGGGFD........................LTPYYGFAEDAVHWHRTAR
280 CoPPO III [Salmonel   ADP...........VW....WFGGGFD........................LTPYYGFEEDAVHWHRTAR
281 CoPPO III [Citrobac   ADP...........VW....WFGGGFD........................LTPYYGFDEDAVHWHRTAR
282 CoPPO III [Rhizobiu   ADP...........VW....WFGGGFD........................LTPFYGFEEDAIHWHRTAR
283 CoPPO III [Vibrio p   ADP...........VW....WFGGGFD........................LTPYYGFEEDAIHWHRTAR
284 CoPPO III [Enteroba   ADP...........VW....WFGGGFD........................LTPYYGFEEDAVHWHRTAR
285 CoPPO III [Enteroba   ADP...........VW....WFGGGFD........................LTPFYGFEEDAIHWHRTAR
286 CoPPO III [Enteroba   ADP...........VW....WFGGGFD........................LTPYYGFEEDAIHWHRTAR
287 CoPPO III [Kluyvera   AEP...........VW....WFGGGFD........................LTPYYGFQEDAVHWHTVAR
288 CoPPO III [Trabulsi   ADP...........VW....WFGGGFD........................LTPFYGFNEDAVHWHTTAR
289 CoPPO III [Raoultel   AEP...........VW....WFGGGFD........................LTPFYGFEEDAVHWHRTAH
290 CoPPO III [Kosakoni   ADP...........VW....WFGGGFD........................LTPYYGFEEDAIHWHRTAR
291 CoPPO III [Enteroco   ADP...........VW....WFGGGFD........................LTPYYGFEEDAVHWHRTAR
292 CoPPO III [gamma pr   EAP...........VW....WFGGGFD........................LTPYYGFEEDARHWHQTAA
293 CoPPO III [Shewanel   ADP...........VW....WFGGGFD........................LTPYYPFEEDVVAWHQSAK
294 CoPPO III [Oceanimo   AEP...........VW....WFGGGFD........................LTPFYPVEEDCRHWHQVSK
295 CoPPO III [Chromoba   EAP...........VW....WFGGGFD........................LTPFYPVREDVVHWHTVAR
296 CoPPO III [Pseudogu   EAP...........VW....WFGGGFD........................LTPYYPQEEDAVHWHTVAR
297 CoPPO III [Chromoba   EAP...........VW....WFGGGFD........................LTPFYPQEEDAVHWHTVAR
298 CoPPO III [Aeromona   EEP...........IW....WFGGGFD........................LTPFYPFEEDVRHWHQVSR
299 CoPPO III [Glacieco   EAP...........IW....WFGGGFD........................LTPFFPFKEDVVHWHKVAH
300 CoPPO III [Alteromo   EAP...........IW....WFGGGFD........................LTPFYPFKDDVVHWHDTAK
301 CoPPO III [Gilvimar   ADP...........VW....WFGGGYD........................LTPFYGFVEDCVHWHKTAF
    Consensus             ADP           VW    WFGGGFD                        LTP YGFEEDA HWH TAR
```

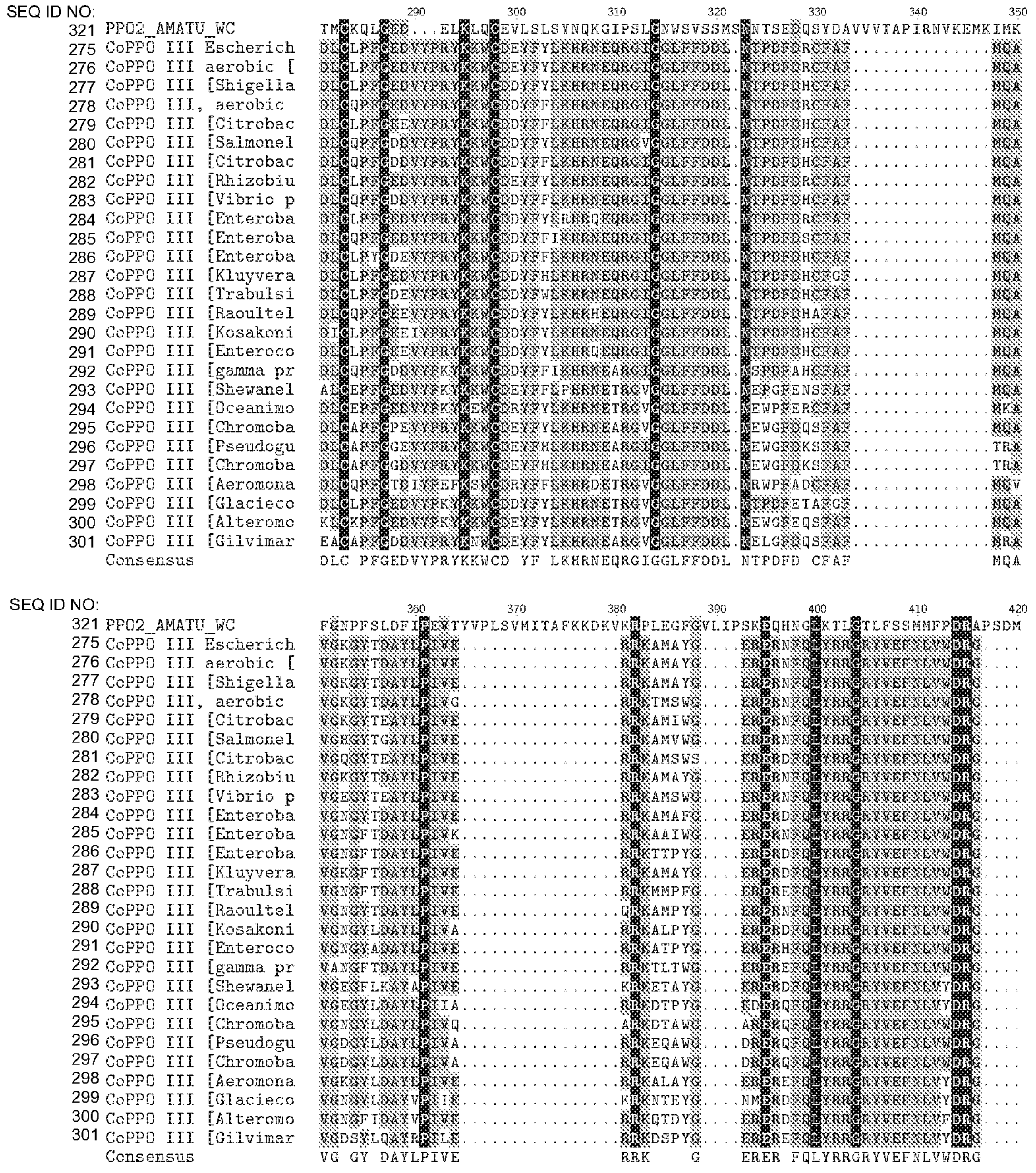

Figure 5 continued

```
SEQ ID NO:                         290        300        310        320        330        340        350
        321 PPO2_AMATU_WC    TM KQI    ...EL LQ EVLSLSYNQKGIPSL NWSVSSMS NTSE QSYDAVVVTAPIRNVKEMKIMK
        275 CoPPO III Escherich                                                                    NQA
        276 CoPPO III aerobic [                                                                    NQA
        277 CoPPO III [Shigella                                                                    NQA
        278 CoPPO III, aerobic                                                                     NQA
        279 CoPPO III [Citrobac                                                                    NQA
        280 CoPPO III [Salmonel                                                                    NQA
        281 CoPPO III [Citrobac                                                                    NQA
        282 CoPPO III [Rhizobiu                                                                    NQA
        283 CoPPO III [Vibrio p                                                                    NQA
        284 CoPPO III [Enteroba                                                                    NQA
        285 CoPPO III [Enteroba                                                                    NQA
        286 CoPPO III [Enteroba                                                                    NQA
        287 CoPPO III [Kluyvera                                                                    NQA
        288 CoPPO III [Trabulsi                                                                    NQA
        289 CoPPO III [Raoultel                                                                    NQA
        290 CoPPO III [Kosakoni                                                                    NQA
        291 CoPPO III [Enteroco                                                                    NQA
        292 CoPPO III [gamma pr                                                                    NQA
        293 CoPPO III [Shewanel                                                                    NQA
        294 CoPPO III [Oceanimo                                                                    NKA
        295 CoPPO III [Chromoba                                                                    NQA
        296 CoPPO III [Pseudogu                                                                    TRA
        297 CoPPO III [Chromoba                                                                    TRA
        298 CoPPO III [Aeromona                                                                    NQV
        299 CoPPO III [Glacieco                                                                    NQA
        300 CoPPO III [Alteromo                                                                    NQA
        301 CoPPO III [Gilvimar                                                                    NRA
            Consensus          DLC PFGEDVYPRYKKWCD YF LKHRNEQRGIGGLFFDDL NTPDFD CFAF           MQA

SEQ ID NO:                         360        370        380        390        400        410        420
        321 PPO2_AMATU_WC    F NPFSLDFI E TYVPLSVMITAFKKDKVK PLEGF VLIPSK QHNG KTL TLFSSMMFP APSDM
        275 CoPPO III Escherich
        276 CoPPO III aerobic [
        277 CoPPO III [Shigella
        278 CoPPO III, aerobic
        279 CoPPO III [Citrobac
        280 CoPPO III [Salmonel
        281 CoPPO III [Citrobac
        282 CoPPO III [Rhizobiu
        283 CoPPO III [Vibrio p
        284 CoPPO III [Enteroba
        285 CoPPO III [Enteroba
        286 CoPPO III [Enteroba
        287 CoPPO III [Kluyvera
        288 CoPPO III [Trabulsi
        289 CoPPO III [Raoultel
        290 CoPPO III [Kosakoni
        291 CoPPO III [Enteroco
        292 CoPPO III [gamma pr
        293 CoPPO III [Shewanel
        294 CoPPO III [Oceanimo
        295 CoPPO III [Chromoba
        296 CoPPO III [Pseudogu
        297 CoPPO III [Chromoba
        298 CoPPO III [Aeromona
        299 CoPPO III [Glacieco
        300 CoPPO III [Alteromo
        301 CoPPO III [Gilvimar
            Consensus          VG GY DAYLPIVE              RRK    G    ERER FQLYRRGRYVEFNLVWDRG
```

Figure 5 continued

```
SEQ ID NO:                                      430       440       450       460       470       480       490
321 PPO2_AMATU_WC              CLFTTFVGGSRNRKLANASTDELKQIVSSDLQQLLGTEDEPSFVNHLFWSNAFPLYGHNYDSVLRAIDKM
275 CoPPO III Escherich        TLFGLQTGGRTESILMSM......................PPLVR..........WEYDYQP........
276 CoPPO III aerobic [        TLFGLQTGGRTESILMSM......................PPLVR..........WEYDYQP........
277 CoPPO III [Shigella        TLFGLQTGGRTESILMSM......................PPLVR..........WEYDYQP........
278 CoPPO III, aerobic         TLFGLQTGGRTESILMSM......................PPLVR..........WEYDYHP........
279 CoPPO III [Citrobac        TLFGLQTGGRTESILMSM......................PPLVR..........WEYDWQP........
280 CoPPO III [Salmonel        TLFGLQTGGRTESILMSM......................PPLVR..........WEYGYQP........
281 CoPPO III [Citrobac        TLFGLQTGGRTESILMSM......................PPLVR..........WEYDWQP........
282 CoPPO III [Rhizobiu        TLFGLQTGGRTESILMSM......................PPLVR..........WEYDYQP........
283 CoPPO III [Vibrio p        TLFGLQTGGRTESILMSM......................PPLVR..........WEYDWQP........
284 CoPPO III [Enteroba        TLFGLQTGGRTESILMSM......................PPLVR..........WEYDYQP........
285 CoPPO III [Enteroba        TLFGLQTGGRTESILMSM......................PPLVR..........WEYDYQP........
286 CoPPO III [Enteroba        TLFGLQTGGRTESILMSM......................PPLVR..........WEYDYHP........
287 CoPPO III [Kluyvera        TLFGLQTGGRTESILMSM......................PPLVR..........WEYNYQP........
288 CoPPO III [Trabulsi        TLFGLQTGGRTESILMSM......................PPLVR..........WEYNYEP........
289 CoPPO III [Raoultel        TLFGLQTGGRTESILMSM......................PPLVR..........WEYDYQP........
290 CoPPO III [Kosakoni        TLFGLQTGGRTESILMSM......................PPLVR..........WEYNYQP........
291 CoPPO III [Enteroco        TLFGLQTGGRTESILMSM......................PPLVR..........WEYDYQP........
292 CoPPO III [gamma pr        TLFGLQTGGRTESILMSM......................PPLVR..........WEYGFEP........
293 CoPPO III [Shewanel        TLFGLQTGGRTESILMSM......................PPLVR..........WQYAYTP........
294 CoPPO III [Oceanimo        TLFGLQTGGRTESILMSM......................PPLAR..........WEYDWQP........
295 CoPPO III [Chromoba        TLFGLQSGGRTESILMSM......................PPLVR..........WEYGYQP........
296 CoPPO III [Pseudogu        TLFGLQSGGRTESILMSM......................PPLVR..........WEYGYQP........
297 CoPPO III [Chromoba        TLFGLQSGGRTESILMSM......................PPLVR..........WEYGYQP........
298 CoPPO III [Aeromona        TLFGLQTGGRTESILMSM......................PPLAR..........WEYDWQP........
299 CoPPO III [Glacieco        TLFGLQTGGRTESILMSM......................PPLVR..........WEYNYVP........
300 CoPPO III [Alteromo        TLFGLQTGGRTESILMSM......................PPLAR..........WEYCYTP........
301 CoPPO III [Gilvimar        TLFGLQTGGRTESILMSL......................PPLVR..........WEYDFHP........
    Consensus                  TLFGLQTGGRTESILMSM                      PPLVR          WEY YQP

SEQ ID NO:                               500       510       520       530       540
321 PPO2_AMATU_WC              EKDLPGFFYAGNHKGGLSVGKAMASGCKAAELVISYLDSHIYVKMDEKTA..
275 CoPPO III Escherich        .......................KDGSPKAAL.SEFIKVRDWV.........
276 CoPPO III aerobic [        .......................KDGSPKAAL.SEFIKVRDWV.........
277 CoPPO III [Shigella        .......................KDGSPKAAL.SEFIKVRDWV.........
278 CoPPO III, aerobic         .......................EDGSPEAAL.SDFIQVRDWV.........
279 CoPPO III [Citrobac        .......................EDGSPEAAL.SEFIKARDWV.........
280 CoPPO III [Salmonel        .......................EEGSPEAAL.CEFIQVRDWVSLPDNSSVS
281 CoPPO III [Citrobac        .......................EANSPEAAL.SEFIQVRDWV.........
282 CoPPO III [Rhizobiu        .......................KDGSPEAAL.SEFIKVRDWV.........
283 CoPPO III [Vibrio p        .......................DAGSPEAAL.SDFIQVREWV.........
284 CoPPO III [Enteroba        .......................EDGSPEAAL.SEFIRVRDWV.........
285 CoPPO III [Enteroba        .......................QAGSPEAAL.SEFIKVRDWV.........
286 CoPPO III [Enteroba        .......................QEGSPEAAL.SEFIKVKEWI.........
287 CoPPO III [Kluyvera        .......................EEGSPKAAL.SEFIKVKDWLL........
288 CoPPO III [Trabulsi        .......................EKGSPKAAL.SEFLQVRDWI.........
289 CoPPO III [Raoultel        .......................EEGSPKAAL.SEFIQVREWI.........
290 CoPPO III [Kosakoni        .......................AEGSPEAAL.SEFIQVKDWV.........
291 CoPPO III [Enteroco        .......................EPGSPEAAL.SEFIQVRDWL.........
292 CoPPO III [gamma pr        .......................DENSPEAALYRDFLPVRDWLAESE.....
293 CoPPO III [Shewanel        .......................EAGSPEAKLYSDFLKPREWLEA.......
294 CoPPO III [Oceanimo        .......................EAGSREARL.QAFLVPRSWV.........
295 CoPPO III [Chromoba        .......................EPGSAEALLYTDFLPPRDWV.........
296 CoPPO III [Pseudogu        .......................EPGSPEARLYTDFLPPRDWV.........
297 CoPPO III [Chromoba        .......................EPGSPEARLYTDFLPPRDWV.........
298 CoPPO III [Aeromona        .......................PAGSPEALLYSDYLKPREWL.........
299 CoPPO III [Glacieco        .......................DEHSAQGKL.AAYLTPQDWLAGQS.....
300 CoPPO III [Alteromo        .......................APGSAKAKL.TDWLKPTPW..........
301 CoPPO III [Gilvimar        .......................EPDSPKARLSRDFLPHQDWLARQ......
    Consensus                                           GSPEAAL S F  VRDWV
```

- non conserved
- ≥ 50% conserved
- all match

PLANTS HAVING INCREASED TOLERANCE TO HERBICIDES

This application is a continuation of U.S. application Ser. No. 15/736,423, which is a National Stage application of International Application No. PCT/IB2016/053512, filed Jun. 15, 2016, which claims priority to European Patent Application No. 15172587.6, filed on Jun. 17, 2015; all of the aforementioned applications are hereby incorporated herein by reference in their entirety.

INCORPORATION BY REFERENCE OF MATERIAL SUBMITTED ELECTRONICALLY

The Sequence Listing, which is a part of the present disclosure, is submitted concurrently with the specification as a text file. The name of the text file containing the Sequence Listing is "78626A_Seqlisting.txt", which was created on Jun. 29, 2022 and is 761,856 bytes in size. The subject matter of the Sequence Listing is incorporated herein in its entirety by reference.

FIELD OF THE INVENTION

The present invention relates in general to methods for conferring on plants agricultural level tolerance to a herbicide. Particularly, the invention refers to plants having an increased tolerance to PPO-inhibiting herbicides. More specifically, the present invention relates to methods and plants obtained by mutagenesis and cross-breeding and transformation that have an increased tolerance to PPO-inhibiting herbicides.

BACKGROUND OF THE INVENTION

Herbicides that inhibit protoporphyrinogen oxidase (hereinafter referred to as Protox or PPO; EC:1.3.3.4), a key enzyme in the biosynthesis of protoporphyrin IX, have been used for selective weed control since the 1960s. PPO catalyzes the last common step in chlorophyll and heme biosynthesis which is the oxidation of protoporphyrinogen IX to protoporphyrin IX. (Matringe et al. 1989. Biochem. 1. 260: 231). PPO-inhibiting herbicides include many different structural classes of molecules (Duke et al. 1991. Weed Sci. 39: 465; Nandihalli et al. 1992. Pesticide Biochem. Physiol. 43: 193; Matringe et al. 1989. FEBS Lett. 245: 35; Yanase and Andoh. 1989. Pesticide Biochem. Physiol. 35: 70). These herbicidal compounds include the diphenylethers {e.g. lactofen, (+−)-2-ethoxy-1-methyl-2-oxoethyl 5-{2-chloro-4-(trifluoromethyl)phenoxy}-2-nitrobenzoate; acifluorfen, 5-{2-chloro-4-(trifluoromethyl)phenoxy}-2-nitrobenzoic acid; its methyl ester; or oxyfluorfen, 2-chloro-1-(3-ethoxy-4-nitrophenoxy)-4-(trifluorobenzene)}, oxidiazoles, (e.g. oxidiazon, 3-{2,4-dichloro-5-(1-methylethoxy)phenyl}-5-(1,1-dimethylethyl)-1,3,4-oxadiazol-2-(3H)-one), cyclic imides (e.g. S-23142, N-(4-chloro-2-fluoro-5-propargyloxyphenyl)-3,4,5,6-tetrahydrophthalimide; chlorophthalim, N-(4-chlorophenyl)-3,4,5,6-tetrahydrophthalimide), phenyl pyrazoles (e.g. TNPP-ethyl, ethyl 2-{1-(2,3,4-trichlorophenyl)-4-nitropyrazolyl-5-oxy}propionate; M&B 39279), pyridine derivatives (e.g. LS 82-556), and phenopylate and its 0-phenylpyrrolidino- and piperidinocarbamate analogs. Many of these compounds competitively inhibit the normal reaction catalyzed by the enzyme, apparently acting as substrate analogs.

Application of PPO-inhibiting herbicides results in the accumulation of protoporphyrinogen IX in the chloroplast and mitochondria, which is believed to leak into the cytosol where it is oxidized by a peroxidase. When exposed to light, protoporphyrin IX causes formation of singlet oxygen in the cytosol and the formation of other reactive oxygen species, which can cause lipid peroxidation and membrane disruption leading to rapid cell death (Lee et al. 1993. Plant Physiol. 102: 881).

Not all PPO enzymes are sensitive to herbicides which inhibit plant PPO enzymes. Both the *Escherichia coli* and *Bacillus subtilis* PPO enzymes (Sasarmen et al. 1993. Can. J. Microbiol. 39: 1155; Dailey et al. 1994. J. Biol. Chem. 269: 813) are resistant to these herbicidal inhibitors. Mutants of the unicellular alga *Chlamydomonas reinhardtii* resistant to the phenylimide herbicide 5-23142 have been reported (Kataoka et al. 1990. J. Pesticide Sci. 15: 449; Shibata et al. 1992. In Research in Photosynthesis, Vol. III, N. Murata, ed. Kluwer: Netherlands. pp. 567-70). At least one of these mutants appears to have an altered PPO activity that is resistant not only to the herbicidal inhibitor on which the mutant was selected, but also to other classes of protox inhibitors (Oshio et al. 1993. Z. Naturforsch. 48c: 339; Sato et al. 1994. In ACS Symposium on Porphyric Pesticides, S. Duke, ed. ACS Press: Washington, D.C.). A mutant tobacco cell line has also been reported that is resistant to the inhibitor S-21432 (Che et al. 1993. Z. Naturforsch. 48c: 350). Auxotrophic *E. coli* mutants have been used to confirm the herbicide resistance of cloned plant PPO-inhibiting herbicides.

Three main strategies are available for making plants tolerant to herbicides, i.e. (1) detoxifying the herbicide with an enzyme which transforms the herbicide, or its active metabolite, into non-toxic products, such as, for example, the enzymes for tolerance to bromoxynil or to basta (EP242236, EP337899); (2) mutating the target enzyme into a functional enzyme which is less sensitive to the herbicide, or to its active metabolite, such as, for example, the enzymes for tolerance to glyphosate (EP293356, Padgette S. R. et al., J. Biol. Chem., 266, 33, 1991); or (3) overexpressing the sensitive enzyme so as to produce quantities of the target enzyme in the plant which are sufficient in relation to the herbicide, in view of the kinetic constants of this enzyme, so as to have enough of the functional enzyme available despite the presence of its inhibitor. The third strategy was described for successfully obtaining plants which were tolerant to PPO inhibitors (see e.g. U.S. Pat. No. 5,767,373 or U.S. Pat. No. 5,939,602, and patent family members thereof). In addition, US 2010/0100988 and WO 2007/024739 discloses nucleotide sequences encoding amino acid sequences having enzymatic activity such that the amino acid sequences are resistant to PPO inhibitor herbicidal chemicals, in particular 3-phenyluracil inhibitor specific PPO mutants.

WO 2012/080975 discloses plants the tolerance of which to a PPO-inhibiting herbicide named "benzoxazinone-derivative" herbicide (1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione) had been increased by transforming said plants with nucleic acids encoding mutated PPO mutated enzymes. In particular, WO 2012/080975 discloses that the introduction of nucleic acids which code for a mutated PPO of an *Amaranthus* type II PPO in which the Arginine at position 128 had been replaced by a leucine, alanine, or valine, and the phenylalanine at position 420 had been replaced by a methionine, cysteine, isoleucine, leucine, or threonine, confers increased tolerance/resistance to a benzoxazinone-derivative herbicide.

Furthermore, WO 2013/189984 discloses that the introduction of nucleic acids which code for a mutated PPO having a substitution corresponding to the Leucine at position 397, and a substitution corresponding to the phenylalanine at position 420 in the *Amaranthus* type II PPO, confers increased tolerance/resistance to a variety of PPO inhibitors herbicide. Furthermore, WO2015/022636 discloses novel substitutions for R128, and F420 corresponding to the *Amaranthus* type II PPO which are not disclosed in WO 2012/080975.

The inventors of the present invention have now surprisingly found that those types of single- and double-mutants and, furthermore, novel substitutions for R128, L397 and F420 which are not disclosed in the prior art confer increased tolerance/resistance to a wide variety of PPO inhibitors when transferred to PPO enzymes derived from organisms other than *Amaranthus*, for example PPO like enzymes from microorganisms (e.g. bacteria), such as those shown in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313. Thus, to date, the prior art has not described PPO-inhibiting herbicide tolerant plants containing a mutated PPO nucleic acid according to the present invention, which are tolerant/resistant to a broad spectrum of PPO inhibitors. Therefore, what is needed in the art are crop plants and crop plants having increased tolerance to herbicides such as PPO-inhibiting herbicide and containing at least one wildtype and/or mutated PPO nucleic acid according to the present invention. Also needed are methods for controlling weed growth in the vicinity of such crop plants or crop plants. These compositions and methods would allow for the use of spray over techniques when applying herbicides to areas containing crop plants or crop plants.

SUMMARY OF THE INVENTION

The problem is solved by the present invention which refers to a method for controlling undesired vegetation at a plant cultivation site, the method comprising the steps of:

a) providing, at said site, a plant that comprises at least one nucleic acid comprising a nucleotide sequence encoding a wild type protoporphyrinogen oxidase (PPO) or a mutated protoporphyrinogen oxidase (mutated PPO) which is resistant or tolerant to a PPO-inhibiting herbicide, and which comprises the amino acid sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, or a variant thereof
b) applying to said site an effective amount of said herbicide.

Another object refers to a method of identifying a nucleotide sequence encoding a mutated PPO which is resistant or tolerant to a PPO-inhibiting herbicide, the method comprising:

a) generating a library of mutated PPO-encoding nucleic acids,
b) screening a population of the resulting mutated PPO-encoding nucleic acids by expressing each of said nucleic acids in a cell or plant and treating said cell or plant with a PPO-inhibiting herbicide,
c) comparing the PPO-inhibiting herbicide-tolerance levels provided by said population of mutated PPO encoding nucleic acids with the PPO-inhibiting herbicide-tolerance level provided by a control PPO-encoding nucleic acid,
d) selecting at least one mutated PPO-encoding nucleic acid that provides a significantly increased level of tolerance to a PPO-inhibiting herbicide as compared to that provided by the control PPO-encoding nucleic acid.

In a preferred embodiment, the mutated PPO-encoding nucleic acid selected in step d) provides at least 2-fold as much tolerance to a PPO-inhibiting herbicide as compared to that provided by the control PPO-encoding nucleic acid.

The resistance or tolerance can be determined by generating a transgenic plant comprising a nucleic acid sequence of the library of step a) and comparing said transgenic plant with a control plant.

Another object refers to a method of identifying a plant or algae containing a nucleic acid encoding a mutated PPO which is resistant or tolerant to a PPO-inhibiting herbicide, the method comprising:

a) identifying an effective amount of a PPO-inhibiting herbicide in a culture of plant cells or green algae.
b) treating said plant cells or green algae with a mutagenizing agent,
c) contacting said mutagenized cells population with an effective amount of PPO-inhibiting herbicide, identified in a), d) selecting at least one cell surviving these test conditions, e) PCR-amplification and sequencing of PPO genes from cells selected in d) and comparing such sequences to wild-type PPO gene sequences, respectively.

In a preferred embodiment, the mutagenizing agent is ethylmethanesulfonate.

Another object refers to an isolated and/or recombinant and/or chemically synthesized nucleic acid encoding a mutated PPO polypeptide comprising the sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, or a variant, derivative, orthologue, paralogue or homologue thereof, as defined hereinafter.

Another object refers to a mutated PPO polypeptide, the polypeptide comprising the sequence set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, as defined hereinafter.

In a preferred embodiment, the nucleic acid being identifiable by a method as defined above.

In another embodiment, the invention refers to a plant cell transformed by and expressing a wild-type or a mutated PPO nucleic acid according to the present invention or a plant which has been mutated to obtain a plant expressing, preferably over-expressing a wild-type or a mutated PPO nucleic acid according to the present invention, wherein expression of said nucleic acid in the plant cell results in increased resistance or tolerance to a PPO-inhibiting herbicide as compared to a wild type variety of the plant cell.

In another embodiment, the invention refers to a plant that expresses a mutagenized or recombinant mutated PPO polypeptide, and wherein said mutated PPO confers upon the plant increased herbicide tolerance as compared to the corresponding wild-type variety of the plant when expressed therein.

In another embodiment, the invention refers to a plant comprising a plant cell according to the present invention, wherein expression of the nucleic acid in the plant results in the plant's increased resistance to PPO-inhibiting herbicide as compared to a wild type variety of the plant.

The plants of the present invention can be transgenic or non-transgenic.

Preferably, the expression of the nucleic acid of the invention in the plant results in the plant's increased resistance to PPO-inhibiting herbicides as compared to a wild type variety of the plant.

In another embodiment, the invention refers to a method for growing the plant according to the present invention while controlling weeds in the vicinity of said plant, said method comprising the steps of:

a) growing said plant; and b) applying a herbicide composition comprising a PPO-inhibiting herbicide to the plant and weeds, wherein the herbicide normally inhibits protoporphyrinogen oxidase, at a level of the herbicide that would inhibit the growth of a corresponding wild-type plant.

In another embodiment, the invention refers to a seed produced by a transgenic plant comprising a plant cell of the present invention, or to a seed produced by the non-transgenic plant that expresses a mutagenized PPO polypeptide, wherein the seed is true breeding for an increased resistance to a PPO-inhibiting herbicide as compared to a wild type variety of the seed.

In another embodiment, the invention refers to a method of producing a transgenic plant cell with an increased resistance to a PPO-inhibiting herbicide as compared to a wild type variety of the plant cell comprising, transforming the plant cell with an expression cassette comprising a wild-type or a mutated PPO nucleic acid.

In another embodiment, the invention refers to a method of producing a transgenic plant comprising, (a) transforming a plant cell with an expression cassette comprising a wild-type or a mutated PPO nucleic acid, and (b) generating a plant with an increased resistance to PPO-inhibiting herbicide from the plant cell.

Preferably, the expression cassette further comprises a transcription initiation regulatory region and a translation initiation regulatory region that are functional in the plant.

In another embodiment, the invention relates to using the mutated PPO of the invention as selectable marker. The invention provides a method of identifying or selecting a transformed plant cell, plant tissue, plant or part thereof comprising a) providing a transformed plant cell, plant tissue, plant or part thereof, wherein said transformed plant cell, plant tissue, plant or part thereof comprises an isolated nucleic acid encoding a mutated PPO polypeptide of the invention as described hereinafter, wherein the polypeptide is used as a selection marker, and wherein said transformed plant cell, plant tissue, plant or part thereof may optionally comprise a further isolated nucleic acid of interest; b)

contacting the transformed plant cell, plant tissue, plant or part thereof with at least one PPO-inhibiting inhibiting compound; c) determining whether the plant cell, plant tissue, plant or part thereof is affected by the inhibitor or inhibiting compound; and d) identifying or selecting the transformed plant cell, plant tissue, plant or part thereof.

The invention is also embodied in purified mutated PPO proteins that contain the mutations described herein, which are useful in molecular modeling studies to design further improvements to herbicide tolerance. Methods of protein purification are well known, and can be readily accomplished using commercially available products or specially designed methods, as set forth for example, in Protein Biotechnology, Walsh and Headon (Wiley, 1994).

In another embodiment, the invention relates to a combination useful for weed control, comprising (a) a polynucleotide encoding a mutated PPO polypeptide according to the present invention, which polynucleotide is capable of being expressed in a plant to thereby provide to that plant tolerance to a PPO inhibiting herbicide; and (b) a PPO inhibiting herbicide.

In another embodiment, the invention relates to a process for preparing a combination useful for weed control comprising (a) providing a polynucleotide encoding a mutated PPO polypeptide according to the present invention, which polynucleotide is capable of being expressed in a plant to thereby provide to that plant tolerance to a PPO inhibiting herbicide; and (b) providing a PPO inhibiting herbicide.

In a preferred embodiment, said step of providing a polynucleotide comprises providing a plant containing the polynucleotide.

In another preferred embodiment, said step of providing a polynucleotide comprises providing a seed containing the polynucleotide.

In another preferred embodiment, said process further comprises a step of applying the PPO inhibiting herbicide to the seed.

In another embodiment, the invention relates to the use of a combination useful for weed control, comprising (a) a polynucleotide encoding a mutated PPO polypeptide according to the present invention, which polynucleotide is capable of being expressed in a plant to thereby provide to that plant tolerance to a PPO inhibiting herbicide; and (b) a PPO inhibiting herbicide, to control weeds at a plant cultivation site.

BRIEF DESCRIPTION OF THE DRAWINGS

FIGS. 1*a* and 1*b* shows amino acid sequence alignments of PPO2 from *Amaranthus tuberculatus* against various Procaryotic sequences that have PPO and/or PPO-like, and/or PPO associated activity.

FIG. 2 shows an amino acid sequence alignments of PPO2 from *Amaranthus tuberculatus* against various Procaryotic sequences that have PPO and/or PPO-like and/or PPO associated activity. Conserved regions are indicated in light grey, grey and black.

FIGS. 3*a*, 3*b* and 3*c* shows amino acid sequence alignments of PPO2 from *Amaranthus tuberculatus* against various Procaryotic hemJ sequences that have CopD (Copper resistant protein D) activity and/or PPO and/or PPO-like, and/or PPO associated activity.

FIGS. 4*a* and 4*b* show amino acid sequence alignments of PPO2 from *Amaranthus tuberculatus* against various Procaryotic hemG sequences that have NADPH (Nicotinamide adenine dinucleotide phosphate)-dependent FMN (Flavin-mononukleotid) reductase activity, and/or PPO and/or PPO-like, and/or PPO associated activity.

FIG. 5 shows amino acid sequence alignments of PPO2 from *Amaranthus tuberculatus* against various Procaryotic hemF sequences that have coproporphyrinogen III oxidase activity, and/or PPO and/or PPO-like, and/or PPO associated activity.

DETAILED DESCRIPTION

Figure 1B:
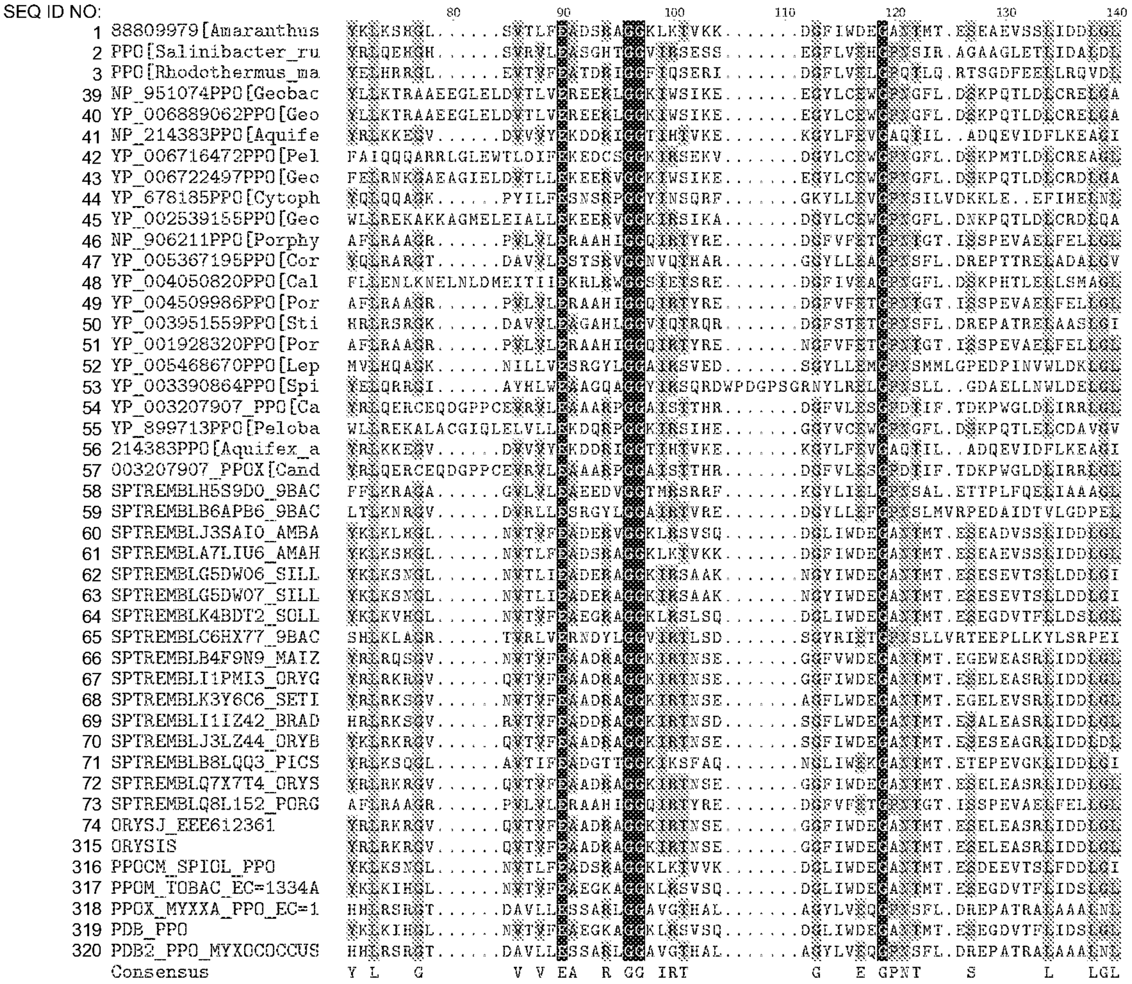
Figure 3B:
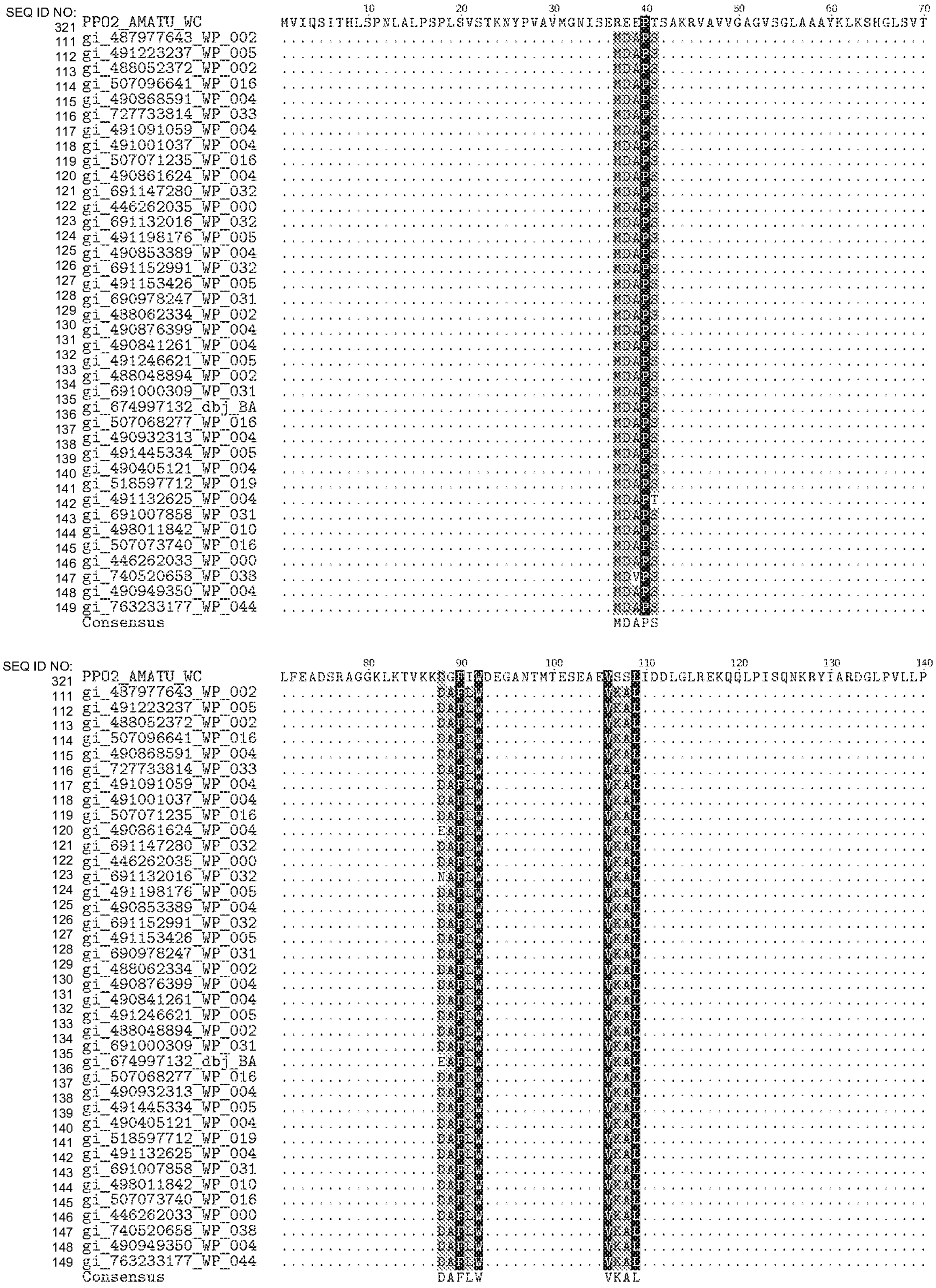
Figure 3B:
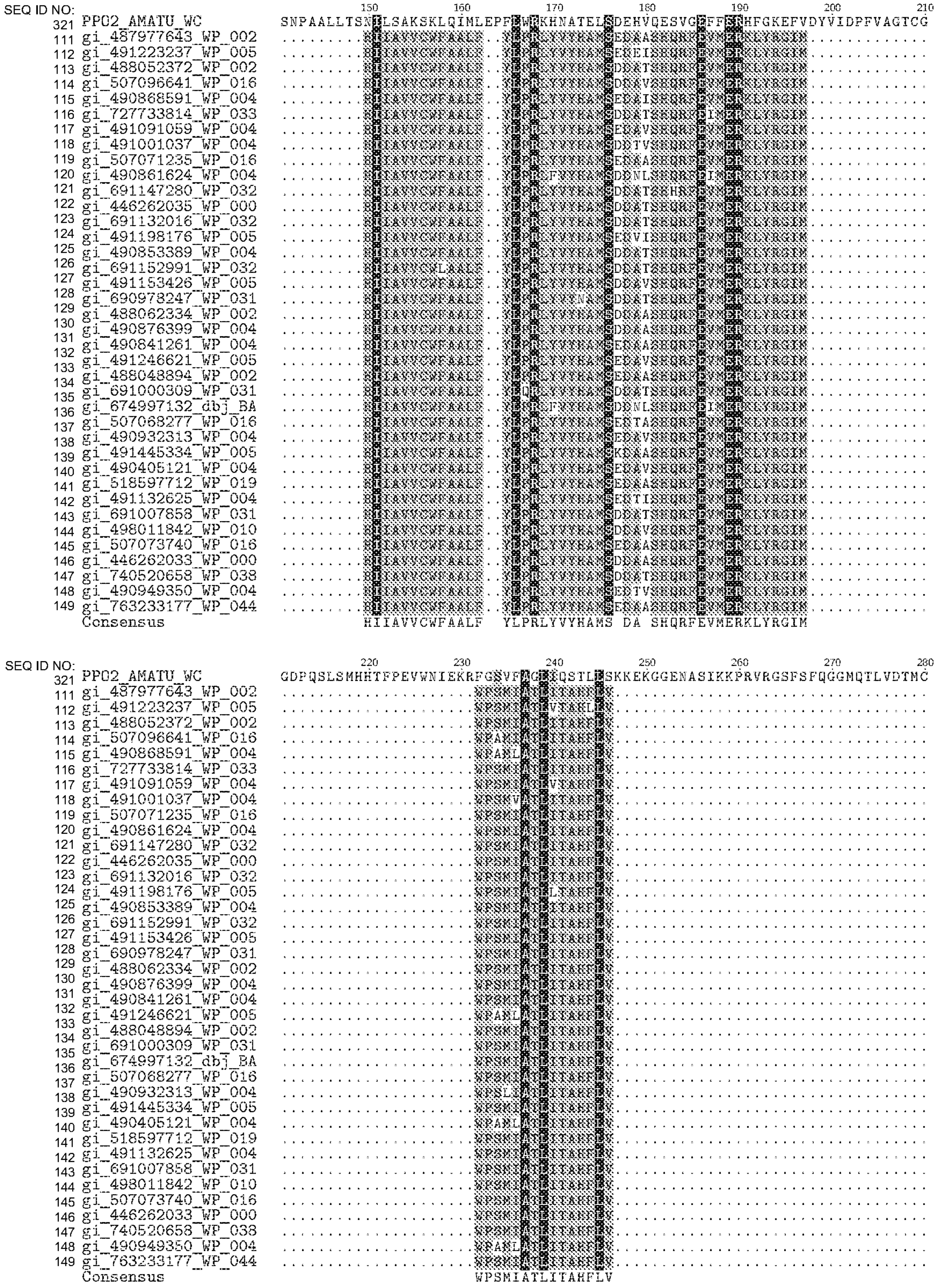
Figure 3B:
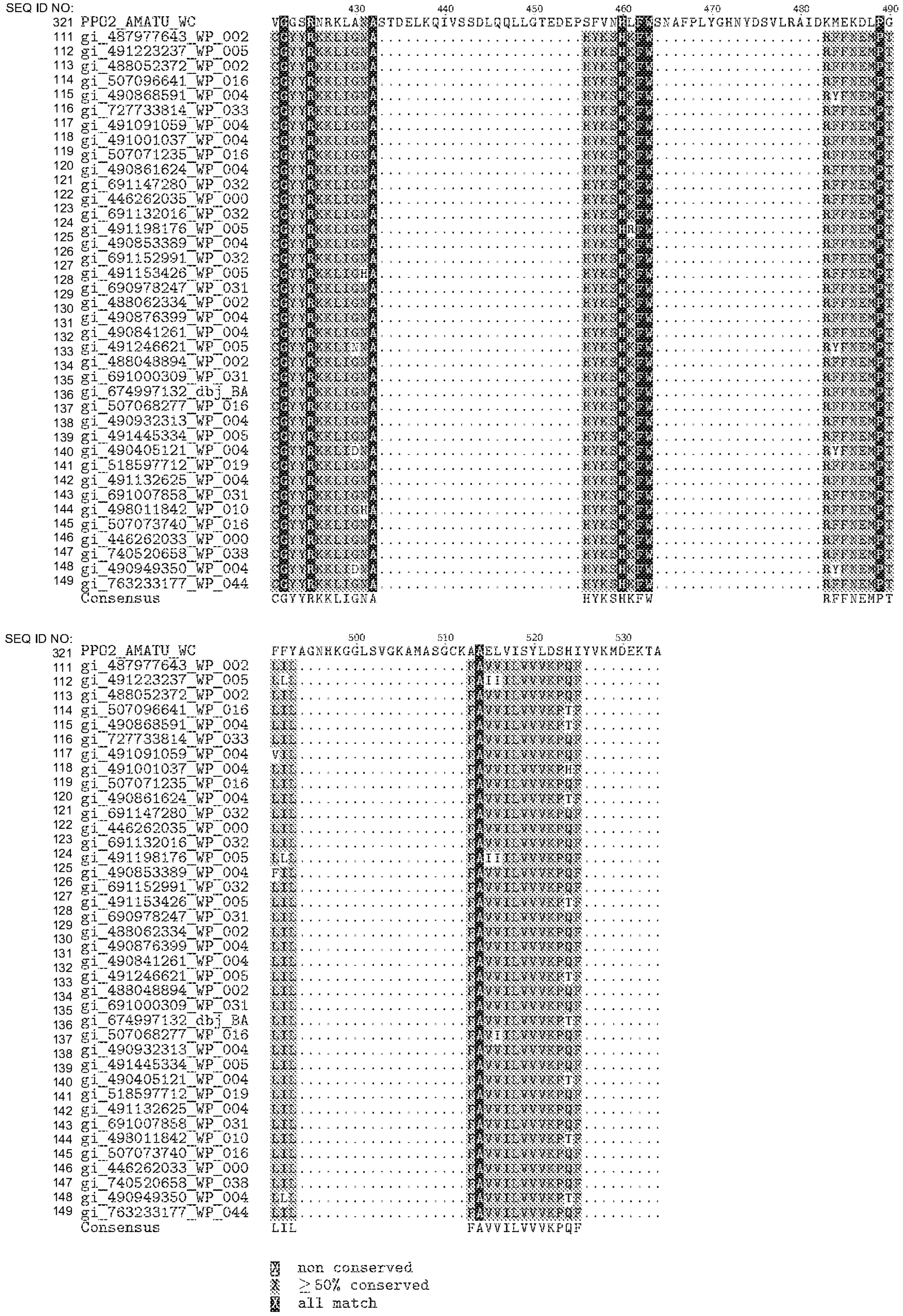
Figure 3C:
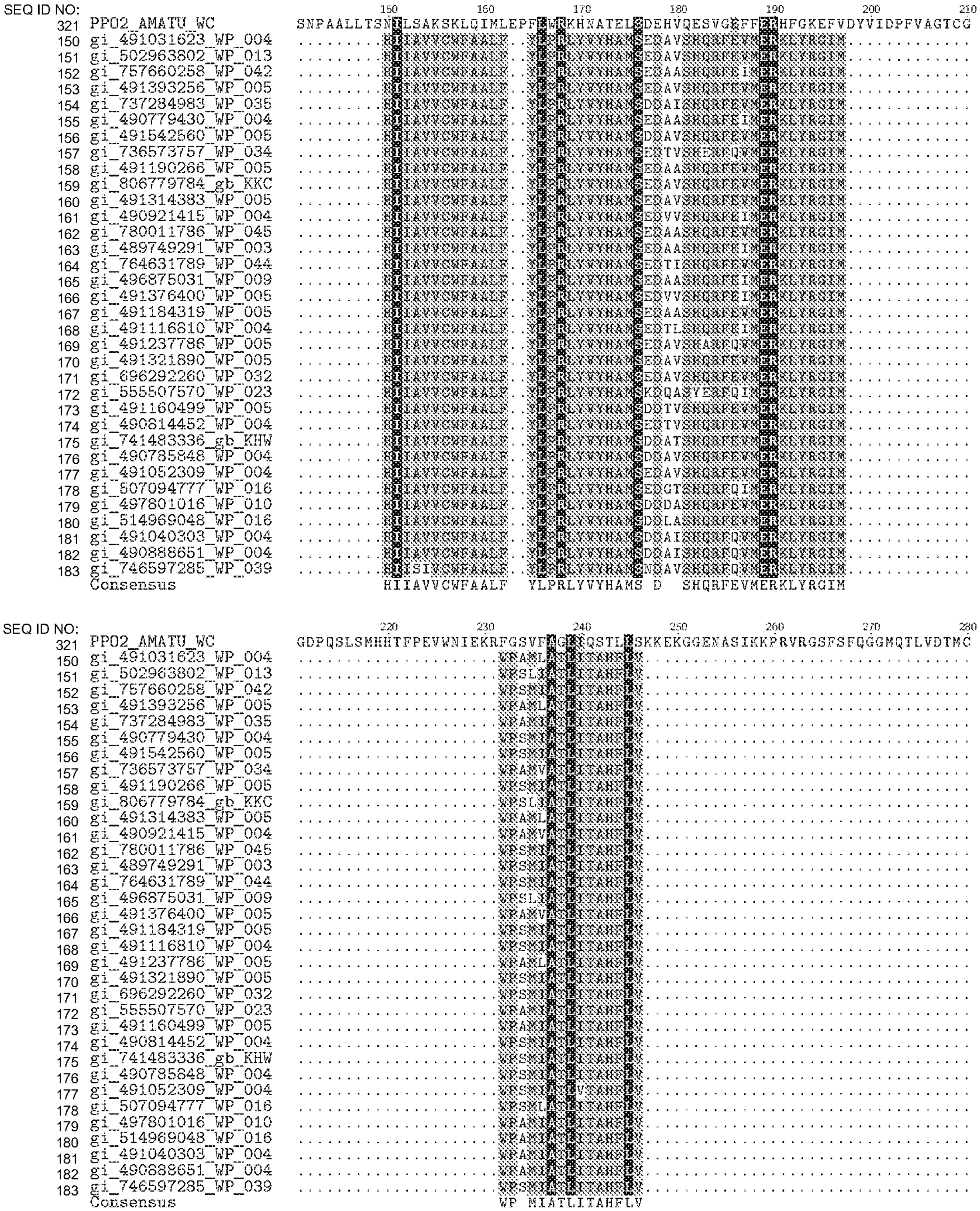
Figure 3C:
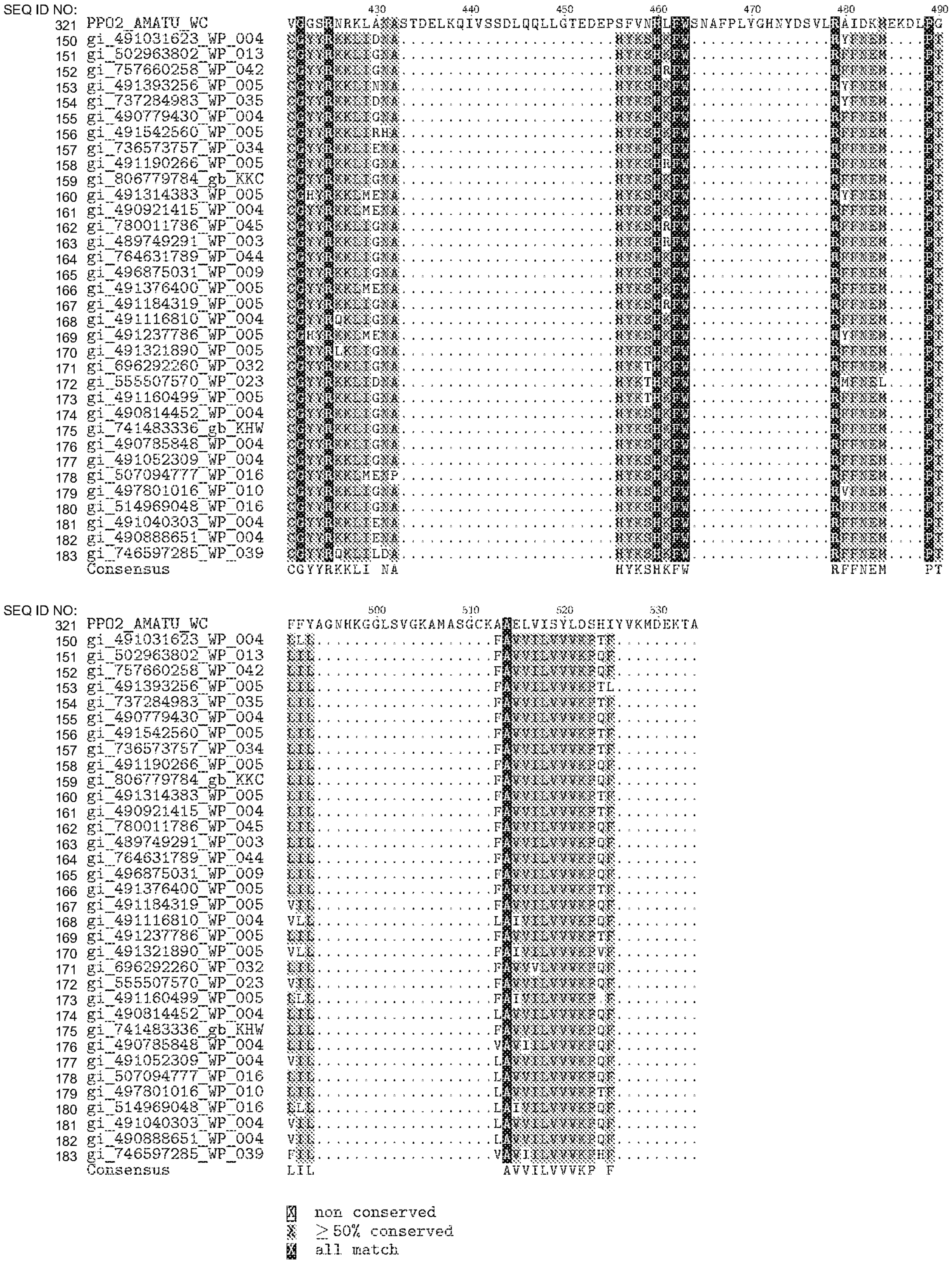
Figure 4A:
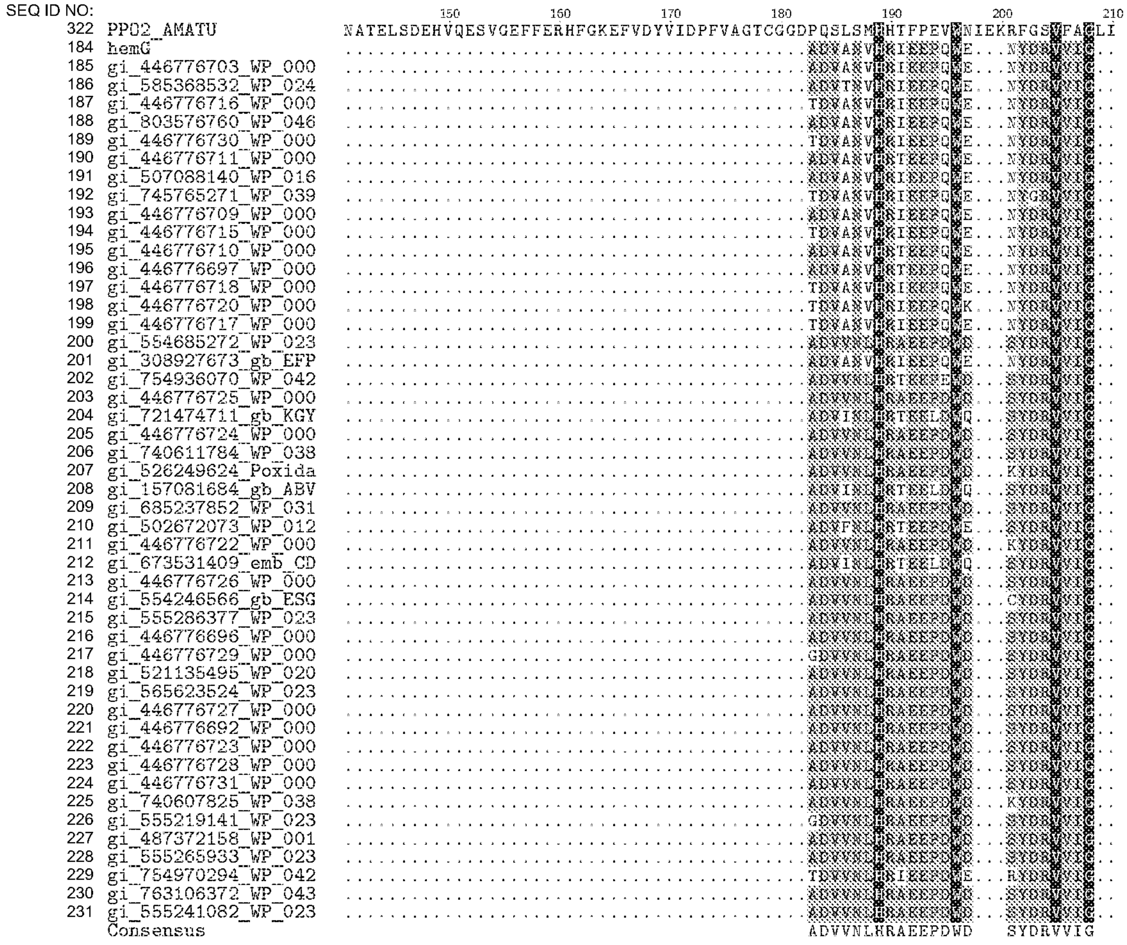
Figure 4A:
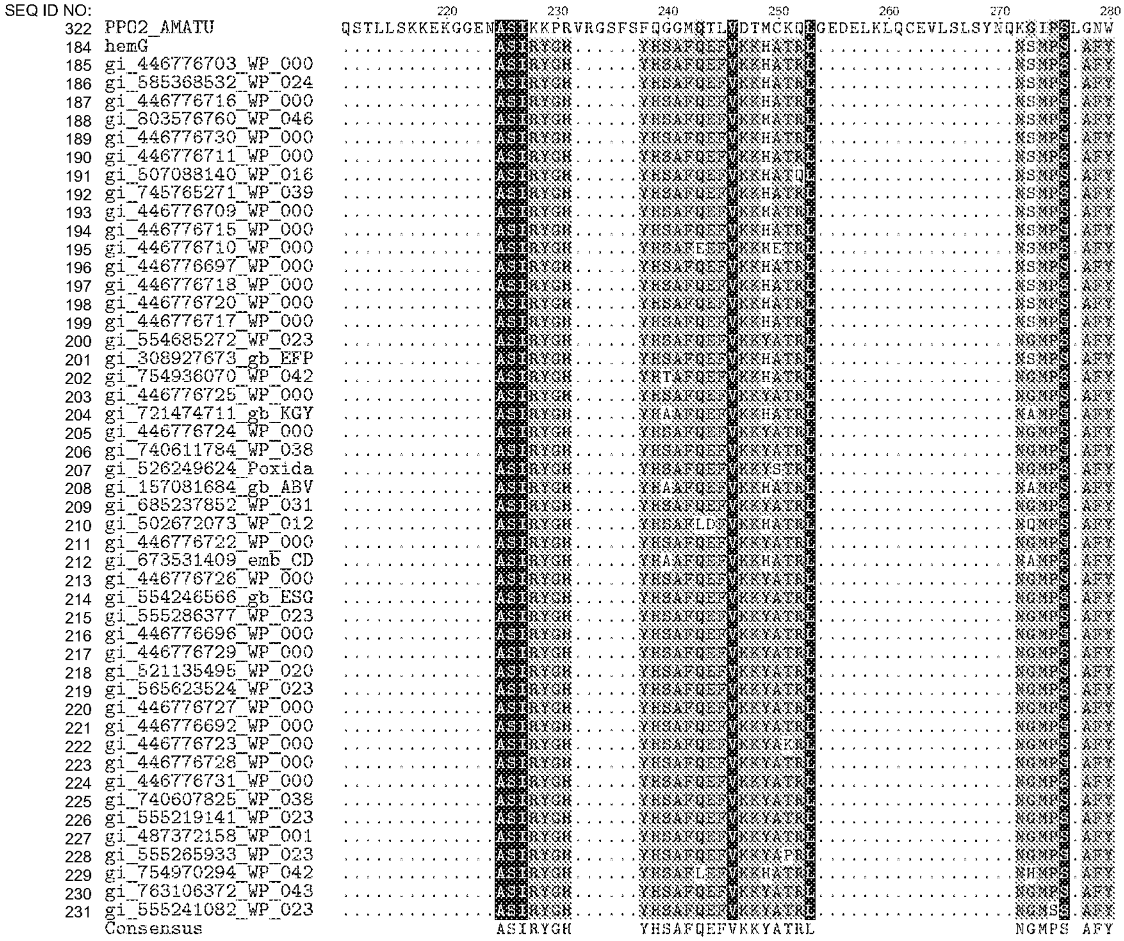
Figure 4A:
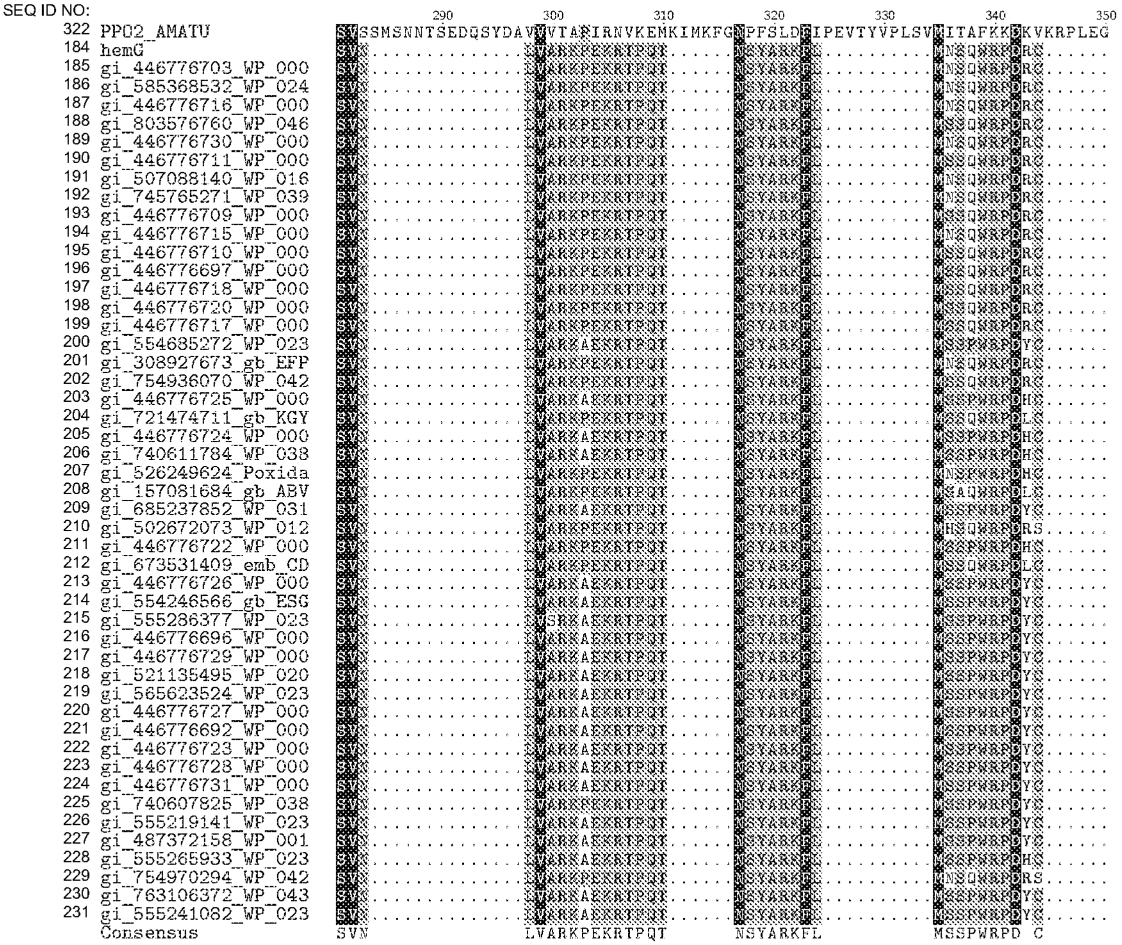

The articles "a" and "an" are used herein to refer to one or more than one (i.e., to at least one) of the grammatical object of the article. By way of example, "an element" means one or more elements.

As used herein, the word "comprising," or variations such as "comprises" or "comprising," will be understood to imply the inclusion of a stated element, integer or step, or group of elements, integers or steps, but not the exclusion of any other element, integer or step, or group of elements, integers or steps.

The inventors of the present invention have found, that the tolerance or resistance of a plant to a PPO-inhibiting herbicide could be remarkably increased by overexpressing a nucleic acid encoding a mutated PPO polypeptide comprising the sequence set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof The present invention refers to a method for controlling undesired vegetation at a plant cultivation site, the method comprising the steps of:

a) providing, at said site, a plant that comprises at least one nucleic acid comprising a nucleotide sequence encoding a wild-type protoporphyrinogen oxidase or a mutated protoporphyrinogen oxidase (mutated PPO) which is resistant or tolerant to a PPO-inhibiting herbicide,
b) applying to said site an effective amount of said herbicide.

The term "control of undesired vegetation" is to be understood as meaning the killing of weeds and/or otherwise retarding or inhibiting the normal growth of the weeds. Weeds, in the broadest sense, are understood as meaning all those plants which grow in locations where they are undesired, e.g. (crop) plant cultivation sites. The weeds of the present invention include, for example, dicotyledonous and monocotyledonous weeds. Dicotyledonous weeds include, but are not limited to, weeds of the genera: *Sinapis, Lepidium, Galium, Stellaria, Matricaria, Anthemis, Galinsoga, Chenopodium, Urtica, Senecio, Amaranthus, Portulaca, Xanthium, Convolvulus, Ipomoea, Polygonum, Sesbania, Ambrosia, Cirsium, Carduus, Sonchus, Solanum, Rorippa, Rotala, Lindernia, Lamium, Veronica, Abutilon, Emex, Datura, Viola, Galeopsis, Papaver, Centaurea, Trifolium, Ranunculus*, and *Taraxacum*. Monocotyledonous weeds include, but are not limited to, weeds of the genera: *Echinochloa, Setaria, Panicum, Digitaria, Phleum, Poa, Festuca, Eleusine, Brachiaria, Lolium, Bromus, Avena, Cyperus, Sorghum, Agropyron, Cynodon, Monochoria, Fimbristyslis, Sagittaria, Eleocharis, Scirpus, Paspalum, Ischaemum, Sphenoclea, Dactyloctenium, Agrostis, Alopecurus*, and *Apera*. In addition, the weeds of the present invention can include, for example, crop plants that are growing in an undesired location. For example, a volunteer maize plant that is in a field that predominantly comprises soybean plants can be considered a weed, if the maize plant is undesired in the field of soybean plants.

The term "plant" is used in its broadest sense as it pertains to organic material and is intended to encompass eukaryotic organisms that are members of the Kingdom Plantae, examples of which include but are not limited to vascular plants, vegetables, grains, flowers, trees, herbs, bushes, grasses, vines, ferns, mosses, fungi and algae, etc, as well as clones, offsets, and parts of plants used for asexual propagation (e.g. cuttings, pipings, shoots, rhizomes, underground stems, clumps, crowns, bulbs, corms, tubers, rhizomes, plants/tissues produced in tissue culture, etc.). The term "plant" further encompasses whole plants, ancestors and progeny of the plants and plant parts, including seeds, shoots, stems, leaves, roots (including tubers), flowers, florets, fruits, pedicles, peduncles, stamen, anther, stigma, style, ovary, petal, sepal, carpel, root tip, root cap, root hair, leaf hair, seed hair, pollen grain, microspore, cotyledon, hypocotyl, epicotyl, xylem, phloem, parenchyma, endosperm, a companion cell, a guard cell, and any other known organs, tissues, and cells of a plant, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana, Agropyron* spp., *Agrostis stolonifera, Allium* spp., *Amaranthus* spp., *Ammophila arenaria, Ananas comosus, Annona* spp., *Apium graveolens, Arachis* spp, *Artocarpus* spp., *Asparagus officinalis, Avena* spp. (e.g. *Avena sativa, Avena fatua, Avena byzantina, Avena fatua* var. *sativa, Avena hybrida*), *Averrhoa carambola, Bambusa* sp., *Benincasa hispida, Bertholletia excelsea, Beta vulgaris, Brassica* spp. (e.g. *Brassica napus, Brassica rapa* ssp. [canola, oilseed rape, turnip rape]), *Cadaba farinosa, Camellia sinensis, Canna indica, Cannabis sativa, Capsicum* spp., *Carex elata, Carica papaya, Carissa macrocarpa, Carya* spp., *Carthamus tinctorius, Castanea* spp., *Ceiba pentandra, Cichorium endivia, Cinnamomum* spp., *Citrullus lanatus, Citrus* spp., *Cocos* spp., *Coffea* spp., *Colocasia esculenta, Cola* spp., *Corchorus* sp., *Coriandrum sativum, Corylus* spp., *Crataegus* spp., *Crocus sativus, Cucurbita* spp., *Cucumis* spp., *Cynara* spp., *Daucus carota, Desmodium* spp., *Dimocarpus longan, Dioscorea* spp., *Diospyros* spp., *Echinochloa* spp., *Elaeis* (e.g. *Elaeis guineensis, Elaeis* oleifera), *Eleusine coracana, Eragrostis tef, Erianthus* sp., *Eriobotrya japonica, Eucalyptus* sp., *Eugenia uniflora, Fagopyrum* spp., *Fagus* spp., *Festuca arundinacea, Ficus carica, Fortunella* spp., *Fragaria* spp., *Ginkgo biloba, Glycine* spp. (e.g. *Glycine max, Soja hispida* or *Soja* max), *Gossypium hirsutum, Helianthus* spp. (e.g. *Helianthus annuus*), *Hemerocallis fulva, Hibiscus* spp., *Hordeum* spp. (e.g. *Hordeum vulgare*), *Ipomoea batatas, Juglans* spp., *Lactuca sativa, Lathyrus* spp., *Lens culinaris, Linum usitatissimum, Litchi chinensis, Lotus* spp., *Luffa acutangula, Lupinus* spp., *Luzula sylvatica, Lycopersicon* spp. (e.g. *Lycopersicon esculentum, Lycopersicon lycopersicum, Lycopersicon pyriforme*), *Macrotyloma* spp., *Malus* spp., *Malpighia emarginata, Mammea americana, Mangifera indica, Manihot* spp., *Manilkara zapota, Medicago sativa, Melilotus* spp., *Mentha* spp., *Miscanthus sinensis, Momordica* spp., *Morus nigra, Musa* spp., *Nicotiana* spp., *Olea* spp., *Opuntia* spp., *Ornithopus* spp., *Oryza* spp. (e.g. *Oryza sativa, Oryza latifolia*), *Panicum miliaceum, Panicum virgatum, Passiflora edulis, Pastinaca sativa, Pennisetum* sp., *Persea* spp., *Petroselinum crispum, Phalaris arundinacea, Phaseolus* spp., *Phleum pratense, Phoenix* spp., *Phragmites australis, Physalis* spp., *Pinus* spp., *Pistacia vera, Pisum* spp., *Poa* spp., *Populus* spp., *Prosopis* spp., *Prunus* spp., *Psidium* spp., *Punica granatum, Pyrus communis, Quercus* spp., *Raphanus sativus, Rheum rhabarbarum, Ribes* spp., *Ricinus communis, Rubus* spp., *Saccharum* spp., *Salix* sp., *Sambucus* spp., *Secale cereale, Sesamum* spp., *Sinapis* sp., *Solanum* spp. (e.g. *Solanum tuberosum, Solanum integrifolium* or *Solanum lycopersicum*), *Sorghum bicolor, Spinacia* spp., *Syzygium* spp., *Tagetes* spp., *Tamarindus indica, Theobroma cacao, Trifolium* spp., *Tripsacum dactyloides, Triticosecale rimpaui, Triticum* spp. (e.g. *Triticum aestivum, Triticum durum, Triticum turgidum, Triticum hybernum, Triticum macha, Triticum sativum, Triticum monococcum* or *Triticum vulgare*), *Tropaeolum minus, Tropaeolum majus, Vaccinium* spp., *Vicia* spp., *Vigna* spp., *Viola odorata, Vitis* spp., *Zea mays, Zizania palustris, Ziziphus* spp., amaranth, artichoke, asparagus, broccoli, Brussels sprouts, cabbage, canola, carrot, cauliflower, celery, collard greens, flax, kale, lentil, oilseed rape, okra, onion, potato, rice, soybean, strawberry, sugar beet, sugar cane, sunflower, tomato, squash, tea and algae, amongst others. According to a preferred embodiment of the present invention, the plant is a crop plant. Examples of crop plants include inter alia soybean, sunflower, canola, alfalfa, rapeseed, cotton, tomato, potato or tobacco. Further preferably, the plant is a monocotyledonous plant, such as sugarcane. Further preferably, the plant is a cereal, such as rice, maize, wheat, barley, millet, rye, *sorghum* or oats.

In a preferred embodiment, the plant has been previously produced by a process comprising recombinantly preparing a plant by introducing and over-expressing a wild-type or mutated PPO transgene according to the present invention, as described in greater detail hereinafter.

In another preferred embodiment, the plant has been previously produced by a process comprising in situ mutagenizing plant cells, to obtain plant cells which express a mutated PPO.

As disclosed herein, the nucleic acids of the invention find use in enhancing the herbicide tolerance of plants that comprise in their genomes a gene encoding a herbicide-tolerant wild-type or mutated PPO protein. Such a gene may be an endogenous gene or a transgene, as described hereinafter.

Therefore, in another embodiment the present invention refers to a method of increasing or enhancing the PPO-inhibitor herbicide tolerance or resistance of a plant, the method comprising overexpressing a nucleic acid encoding a mutated PPO polypeptide comprising the sequence set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof.

Additionally, in certain embodiments, the nucleic acids of the present invention can be stacked with any combination of polynucleotide sequences of interest in order to create plants with a desired phenotype. For example, the nucleic acids of the present invention may be stacked with any other polynucleotides encoding polypeptides having pesticidal and/or insecticidal activity, such as, for example, the *Bacillus thuringiensis* toxin proteins (described in U.S. Pat. Nos. 5,366,892; 5,747,450; 5,737,514; 5,723,756; 5,593,881; and Geiser et al (1986) Gene 48: 109).

By way of example, polynucleotides that may be stacked with the nucleic acids of the present invention include nucleic acids encoding polypeptides conferring resistance to pests/pathogens such as viruses, nematodes, insects or fungi, and the like. Exemplary polynucleotides that may be stacked with nucleic acids of the invention include polynucleotides encoding: polypeptides having pesticidal and/or insecticidal activity, such as other *Bacillus thuringiensis* toxic proteins (described in U.S. Pat. Nos. 5,366,892; 5,747,450; 5,737,514; 5,723,756; 5,593,881; and Geiser et al., (1986) Gene 48:109), lectins (Van Damme et al. (1994) Plant Mol. Biol. 24:825, pentin (described in U.S. Pat. No. 5,981,722), and the like; traits desirable for disease or herbicide resistance (e.g., fumonisin detoxification genes (U.S. Pat. No. 5,792,931); avirulence and disease resistance genes (Jones et al. (1994) Science 266:789; Martin et al., (1993) Science 262: 1432; Mindrinos et al. (1994) Cell 78:1089); acetolactate synthase (ALS) mutants that lead to herbicide resistance such as the S4 and/or Hra mutations; glyphosate resistance (e.g., 5-enol-pyrovyl-shikimate-3-phosphate-synthase (EPSPS) gene, described in U.S. Pat. Nos. 4,940,935 and 5,188,642; or the glyphosate N-acetyltransferase (GAT) gene, described in Castle et al. (2004) Science, 304:1151-1154; and in U.S. Patent App. Pub. Nos. 20070004912, 20050246798, and 20050060767)); glufosinate resistance (e.g, phosphinothricin acetyl transferase genes PAT and BAR, described in U.S. Pat. Nos. 5,561,236 and 5,276,268); resistance to herbicides including sulfonyl urea, DHT (2,4D), and PPO herbicides (e.g., glyphosate acetyl transferase, aryloxy alkanoate dioxygenase, acetolactate synthase, and protoporphyrinogen oxidase); a cytochrome P450 or variant thereof that confers herbicide resistance or tolerance to, inter alia, HPPD herbicides (U.S. patent application Ser. No. 12/156,247; U.S. Pat. Nos. 6,380,465; 6,121,512; 5,349,127; 6,649,814; and 6,300,544; and PCT Patent App. Pub. No. WO2007000077); and traits desirable for processing or process products such as high oil (e.g., U.S. Pat. No. 6,232,529); modified oils (e.g., fatty acid desaturase genes (U.S. Pat. No. 5,952,544; WO 94/11516)); modified starches (e.g., ADPG pyrophosphorylases (AGPase), starch synthases (SS), starch branching enzymes (SBE), and starch debranching enzymes (SDBE)); and polymers or bioplastics (e.g., U.S. Pat. No. 5,602,321; beta-ketothiolase, polyhydroxybutyrate synthase, and acetoacetyl-CoA reductase (Schubert et al. (1988) J. Bacteriol. 170:5837-5847) facilitate expression of polyhydroxyalkanoates (PHAs)); the disclosures of which are herein incorporated by reference.

In a preferred embodiment, the plant comprises at least one additional heterologous nucleic acid comprising a nucleotide sequence encoding a herbicide tolerance enzyme selected, for example, from the group consisting of 5-enolpyruvylshikimate-3-phosphate synthase (EPSPS), Glyphosate acetyl transferase (GAT), cytochrome P450 monooxygenase, phosphinothricin acetyltransferase (PAT), Acetohydroxyacid synthase (AHAS; EC 4.1.3.18, also known as acetolactate synthase or ALS), hydroxyphenyl pyruvate dioxygenase (HPPD), Phytoene desaturase (PD) and dicamba degrading enzymes as disclosed in WO 02/068607, or phenoxyaceticacid- and phenoxypropionicacid-derivative degrading enzymes as disclosed in WO 2008141154 or WO 2005107437. The combinations generated can also include multiple copies of any one of the polynucleotides of interest.

Generally, the term "herbicide" is used herein to mean an active ingredient that kills, controls or otherwise adversely modifies the growth of plants. The preferred amount or concentration of the herbicide is an "effective amount" or "effective concentration." By "effective amount" and "effective concentration" is intended an amount and concentration, respectively, that is sufficient to kill or inhibit the growth of a similar, wild-type, plant, plant tissue, plant cell, or host cell, but that said amount does not kill or inhibit as severely the growth of the herbicide-resistant plants, plant tissues, plant cells, and host cells of the present invention. Typically, the effective amount of a herbicide is an amount that is routinely used in agricultural production systems to kill weeds of interest. Such an amount is known to those of ordinary skill in the art. Herbicidal activity is exhibited by herbicides useful for the present invention when they are applied directly to the plant or to the locus of the plant at any stage of growth or before planting or emergence. The effect observed depends upon the plant species to be controlled, the stage of growth of the plant, the application parameters of dilution and spray drop size, the particle size of solid components, the environmental conditions at the time of use, the specific compound employed, the specific adjuvants and carriers employed, the soil type, and the like, as well as the amount of chemical applied. These and other factors can be adjusted as is known in the art to promote non-selective or selective herbicidal action. Generally, it is preferred to apply the herbicide postemergence to relatively immature undesirable vegetation to achieve the maximum control of weeds.

By a "herbicide-tolerant" or "herbicide-resistant" plant, it is intended that a plant that is tolerant or resistant to at least one herbicide at a level that would normally kill, or inhibit the growth of, a normal or wild-type plant. By "herbicide-tolerant wildtype or mutated PPO protein" or "herbicide-resistant wildtype or mutated PPO protein", it is intended that such a PPO protein displays higher PPO activity, relative to the PPO activity of a wild-type PPO protein, when in the presence of at least one herbicide that is known to interfere with PPO activity and at a concentration or level of the herbicide that is known to inhibit the PPO activity of the wild-type mutated PPO protein. Furthermore, the PPO activity of such a herbicide-tolerant or herbicide-resistant mutated PPO protein may be referred to herein as "herbicide-tolerant" or "herbicide-resistant" PPO activity.

Generally, if the PPO-inhibiting herbicides (also referred to as compounds A) and/or the herbicidal compounds B as described herein, which can be employed in the context of the present invention, are capable of forming geometrical isomers, for example E/Z isomers, it is possible to use both, the pure isomers and mixtures thereof, in the compositions useful for the present the invention. If the PPO-inhibiting herbicides A and/or the herbicidal compounds B as described herein have one or more centers of chirality and, as a consequence, are present as enantiomers or diastereomers, it is possible to use both, the pure enantiomers and diastereomers and their mixtures, in the compositions according to the invention. If the PPO-inhibiting herbicides A and/or the herbicidal compounds B as described herein have ionizable functional groups, they can also be employed in the form of their agriculturally acceptable salts. Suitable are, in general, the salts of those cations and the acid addition salts of those acids whose cations and anions, respectively, have no adverse effect on the activity of the active compounds.

Preferred cations are the ions of the alkali metals, preferably of lithium, sodium and potassium, of the alkaline earth metals, preferably of calcium and magnesium, and of the transition metals, preferably of manganese, copper, zinc and iron, further ammonium and substituted ammonium in which one to four hydrogen atoms are replaced by $C_1$-$C_4$-alkyl, hydroxy-$C_1$-$C_4$-alkyl, $C_1$-$C_4$-alkoxy-$C_1$-$C_4$-alkyl, hydroxy-$C_1$-$C_4$-alkoxy-$C_1$-$C_4$-alkyl, phenyl or benzyl, preferably ammonium, methylammonium, isopropylammonium, dimethylammonium, diisopropylammonium, trimethylammonium, heptylammonium, dodecylammonium, tetradecylammonium, tetramethylammonium, tetraethylammonium, tetrabutylammonium, 2-hydroxyethylammonium (olamine salt), 2-(2-hydroxyeth-1-oxy)eth-1-ylammonium (diglycolamine salt), di(2-hydroxyeth-1-yl)ammonium (diolamine salt), tris(2-hydroxyethyl)ammonium (trolamine salt), tris(2-hydroxypropyl)ammonium, benzyltrimethylammonium, benzyltriethylammonium, N,N,N-trimethylethanolammonium (choline salt), furthermore phosphonium ions, sulfonium ions, preferably tri($C_1$-$C_4$-alkyl)sulfonium, such as trimethylsulfonium, and sulfoxonium ions, preferably tri($C_1$-$C_4$-alkyl)sulfoxonium, and finally the salts of polybasic amines such as N,N-bis-(3-aminopropyl)methylamine and diethylenetriamine. Anions of useful acid addition salts are primarily chloride, bromide, fluoride, iodide, hydrogensulfate, methylsulfate, sulfate, dihydrogenphosphate, hydrogenphosphate, nitrate, bicarbonate, carbonate, hexafluorosilicate, hexafluorophosphate, benzoate and also the anions of $C_1$-$C_4$-alkanoic acids, preferably formate, acetate, propionate and butyrate.

The PPO-inhibiting herbicides A and/or the herbicidal compounds B as described herein having a carboxyl group can be employed in the form of the acid, in the form of an agriculturally suitable salt as mentioned above or else in the form of an agriculturally acceptable derivative, for example as amides, such as mono- and di-$C_1$-$C_6$-alkylamides or arylamides, as esters, for example as allyl esters, propargyl esters, $C_1$-$C_{10}$-alkyl esters, alkoxyalkyl esters, tefuryl ((tetrahydrofuran-2-yl)methyl) esters and also as thioesters, for example as $C_1$-$C_{10}$-alkylthio esters. Preferred mono- and di-$C_1$-$C_6$-alkylamides are the methyl and the dimethylamides. Preferred arylamides are, for example, the anilides and the 2-chloroanilides. Preferred alkyl esters are, for example, the methyl, ethyl, propyl, isopropyl, butyl, isobutyl, pentyl, mexyl (1-methylhexyl), meptyl (1-methylheptyl), heptyl, octyl or isooctyl (2-ethylhexyl) esters. Preferred $C_1$-$C_4$-alkoxy-$C_1$-$C_4$-alkyl esters are the straight-chain or branched $C_1$-$C_4$-alkoxy ethyl esters, for example the 2-methoxyethyl, 2-ethoxyethyl, 2-butoxyethyl (butotyl), 2-butoxypropyl or 3-butoxypropyl ester. An example of a straight-chain or branched $C_1$-$C_{10}$-alkylthio ester is the ethylthio ester.

Examples of PPO inhibiting herbicides which can be used according to the present invention are acifluorfen, acifluorfen-sodium, aclonifen, azafenidin, bencarbazone, benzfendizone, bifenox, butafenacil, carfentrazone, carfentrazone-ethyl, chlomethoxyfen, cinidon-ethyl, fluazolate, flufenpyr, flufenpyr-ethyl, flumiclorac, flumiclorac-pentyl, flumioxazin, fluoroglycofen, fluoroglycofen-ethyl, fluthiacet, fluthiacet-methyl, fomesafen, halosafen, lactofen, oxadiargyl, oxadiazon, oxyfluorfen, pentoxazone, profluazol, pyraclonil, pyraflufen, pyraflufen-ethyl, saflufenacil, sulfentrazone, thidiazimin, tiafenacil, chlornitrofen, flumipropyn, fluoronitrofen, flupropacil, furyloxyfen, nitrofluorfen, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), N-ethyl-3-2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethyl-phenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione (CAS 451484-50-7), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione (CAS 1300118-96-0), 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione, methyl (E)-4-[2-chloro-5-[4-chloro-5-(difluoromethoxy)-1H-methyl-pyrazol-3-yl]-4-fluoro-phenoxyl-3-methoxy-but-2-enoate [CAS 948893-00-3], 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4), and uracils of formula III

III

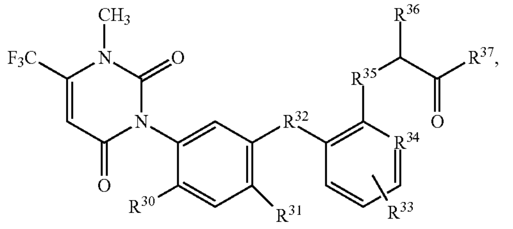

wherein $R^{30}$ and $R^{31}$ independently of one another are F, Cl or CN;

$R^{32}$ is O or S;

$R^{33}$ is H, F, Cl, $CH_3$ or $OCH_3$;

$R^{34}$ is CH or N;

$R^{35}$ is O or S;

$R^{36}$ is H, CN, $CH_3$, $CF_3$, $OCH_3$, $OC_2H_5$, $SCH_3$, $SC_2H_5$, $(CO)OC_2H_5$ or $CH_2R^{38}$, wherein $R^{38}$ is F, Cl, $OCH_3$, $SCH_3$, $SC_2H_5$, $CH_2F$, $CH_2Br$ or $CH_2OH$;

and $R^{37}$ is ($C_1$-$C_6$-alkyl)amino, ($C_1$-$C_6$-dialkyl)amino, (NH)$OR^{39}$, OH, $OR^{40}$ or $SR^{40}$ wherein $R^{39}$ is $CH_3$, $C_2H_5$ or phenyl; and $R^{40}$ is independently of one another $C_1$-$C_6$-alkyl, $C_2$-$C_6$-alkenyl, $C_3$-$C_6$-alkynyl, $C_1$-$C_6$-haloalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, $C_2$-$C_6$-cyanoalkyl, $C_1$-$C_4$-alkoxy-carbonyl-$C_1$-$C_4$-alkyl, $C_1$-$C_4$-alkyl-carbonyl-amino, $C_1$-$C_6$ alkylsulfinyl $C_1$-$C_6$ alkyl, $C_1$-$C_6$-alkyl-sulfonyl-$C_1$-$C_6$-alkyl, $C_1$-$C_6$-dialkoxy-$C_1$-$C_6$-alkyl, $C_1$-$C_6$-alkyl-carbonyloxy-$C_1$-$C_6$-alkyl, phenyl-carbonyl-$C_1$-$C_6$-alkyl, tri($C_1$-$C_3$-alkyl)-silyl-$C_1$-$C_6$-alkyl, tri($C_1$-$C_3$ alkyl) silyl $C_1$-$C_6$ alkenyl, tri($C_1$-$C_3$ alkyl) silyl $C_1$-$C_6$ alkynyl, tri($C_1$-$C_3$-alkyl)-silyl-$C_1$-$C_6$-alkoxy-$C_1$-$C_6$-alkyl, dimethylamino, tetrahydropyranyl, tetrahydrofuranyl-$C_1$-$C_3$-alkyl, phenyl-$C_1$-$C_6$-alkoxy-$C_1$-$C_6$-alkyl, phenyl-$C_1$-$C_3$-alkyl, pyridyl-$C_1$-$C_3$-alkyl, pyridyl, phenyl, which pyridyls and phenyls independently of one another are substituted by one to five substituents selected from the group consisting of halogen, $C_1$-$C_3$-alkyl or $C_1$-$C_2$-haloalkyl;

$C_3$-$C_6$-cycloalkyl or $C_3$-$C_6$-cycloalkyl-$C_1$-$C_4$-alkyl, which cycloalkyls independently of one another are unsubstituted or substituted by one to five substituents selected from the group consisting of halogen, $C_1$-$C_3$-alkyl and $C_1$-$C_2$-haloalkyl;

including their agriculturally acceptable alkali metal salts or ammonium salts.

Preferred PPO-inhibiting herbicides that can be used according to the present invention are: Acifluorfen, acifluorfen-sodium, azafenidin, bencarbazone, benzfendizone, butafenacil, carfentrazone-ethyl, cinidon-ethyl, flufenpyr-ethyl, flumiclorac-pentyl, flumioxazin, fluoroglycofen-ethyl, fluthiacet-methyl, fomesafen, lactofen, oxadiargyl, oxadiazon, oxyfluorfen, pentoxazone, pyraflufen-ethyl, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxyl-acetate (CAS 353292-31-6; 5-3100), N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione (CAS 451484-50-7), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione (CAS 1300118-96-0); 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione (CAS 1304113-05-0), 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4)

uracils of formula III.1 (corresponding to uracils of formula III, wherein $R^{30}$ is F, $R^{31}$ is Cl, $R^{32}$ is O; $R^{33}$ is H; $R^{34}$ is CH; $R^{35}$ is O and $R^{37}$ is $OR^{40}$)

III.1

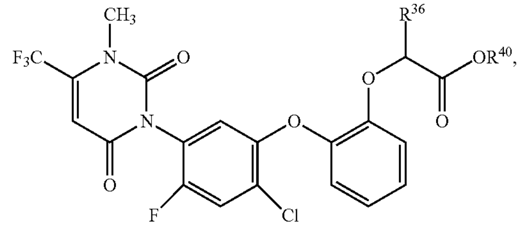

wherein $R^{36}$ is $OCH_3$, $OC_2H_5$, $SCH_3$ or $SC_2H_5$;

and $R^{40}$ is $C_1$-$C_6$-alkyl, $C_2$-$C_6$-alkenyl, $C_3$-$C_6$-alkynyl, $C_1$-$C_6$-haloalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, $C_1$-$C_3$-cyanoalkyl, phenyl-$C_1$-$C_3$-alkyl, pyridyl-$C_1$-$C_3$-alkyl, $C_3$-$C_6$-cycloalkyl or $C_3$-$C_6$-cycloalkyl-$C_1$-$C_4$-alkyl, which cycloalkyls are unsubstituted or substituted by one to five substituents selected from the group consisting of halogen, $C_1$-$C_3$-alkyl and $C_1$-$C_2$-haloalkyl;

and uracils of formula III.2 (corresponding to uracils of formula III, wherein $R^{30}$ is F; $R^{31}$ is Cl; $R^{32}$ is O; $R^{33}$ is H; $R^{34}$ is N; $R^{35}$ is O and $R^{37}$ is $OR^{40}$ with $R^{40}$ is $C_1$-$C_6$-alkyl)

III.2

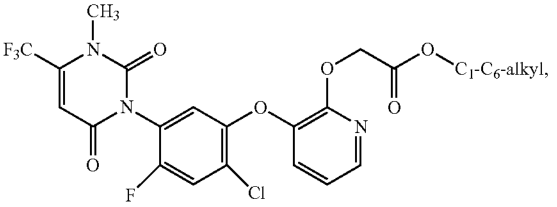

Particularly preferred PPO-inhibiting herbicides that can be used according to the present invention are:

acifluorfen, acifluorfen-sodium, butafenacil, carfentrazone-ethyl, cinidon-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)-phenoxy]-2-pyridyloxy]acetate (CAS 353292-31-6; S-3100), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione (CAS 451484-50-7), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), and 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione (CAS 1300118-96-0), 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione (CAS 1304113-05-0), uracils of formula III.1.1 (corresponding to uracils of formula III, wherein $R^{30}$ is F, $R^{31}$ is Cl, $R^{32}$ is O; $R^{33}$ is H; $R^{34}$ is CH; $R^{35}$ is O, $R^{36}$ is $OCH_3$ and $R^{37}$ is $OR^{40}$)

III.1.1

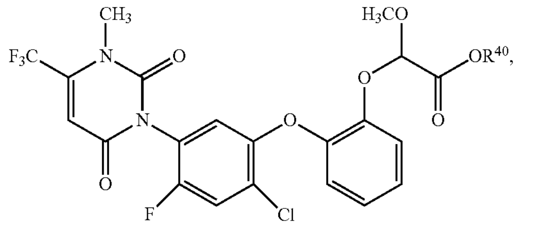

wherein $R^{40}$ is $C_1$-$C_6$-alkyl, $C_2$-$C_6$-alkenyl, $C_3$-$C_6$-alkynyl, $C_1$-$C_6$-haloalkyl, $C_1$-$C_6$-alkoxy-$C_1$-$C_6$-alkyl, $C_1$-$C_6$-alkoxy-$C_1$-$C_6$-alkoxy-$C_1$-$C_6$-alkyl, $C_1$-$C_3$-cyanoalkyl, phenyl-$C_1$-$C_3$-alkyl, pyridyl-$C_1$-$C_3$-alkyl, $C_3$-$C_6$-cycloalkyl or $C_3$-$C_6$-cycloalkyl-$C_1$-$C_4$-alkyl, which cycloalkyls are unsubstituted or substituted by one to five substituents selected from the group consisting of halogen, $C_1$-$C_3$-alkyl and $C_1$-$C_2$-haloalkyl;

is preferably $CH_3$, $CH_2CH_2OC_2H_5$, $CH_2CHF_2$, cyclohexyl, (1-methylcyclopropyl)methyl or $CH_2$(pyridine-4-yl);

uracils of formula III.2.1 (corresponding to uracils of formula III, wherein $R^{30}$ is F; $R^{31}$ is Cl; $R^{32}$ is O; $R^{33}$ is H; $R^{34}$ is N; $R^{35}$ is O and $R^{37}$ is $OR^{40}$ with $R^{40}$ is $CH_3$)

III.2.1

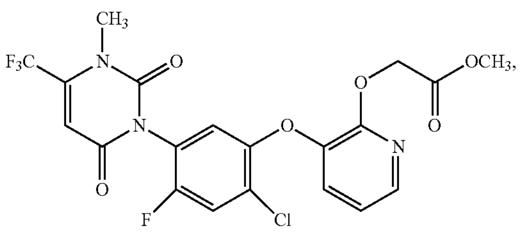

and uracils of formula III.2.2 (corresponding to uracils of formula III, wherein $R^{30}$ is F; $R^{31}$ is Cl; $R^{32}$ is O; $R^{33}$ is H; $R^{34}$ is N; $R^{35}$ is O and $R^{37}$ is $OR^{40}$ with $R^{40}$ is $C_2H_5$)

III.2.2

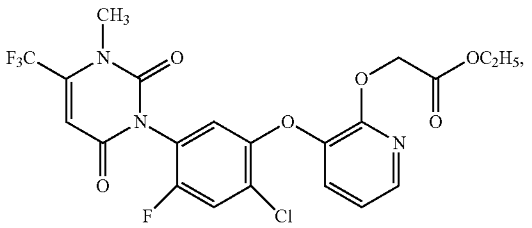

Especially preferred PPO-inhibiting herbicides are the PPO-inhibiting herbicides.1 to A.14 listed below in table A:

TABLE A

| | |
|---|---|
| A.1 | acifluorfen |
| A.2 | butafenacil |
| A.3 | carfentrazone-ethyl |
| A.4 | cinidon-ethyl |
| A.5 | flumioxazin |
| A.6 | fluthiacet-methy |
| A.7 | fomesafen |
| A.8 | lactofen |
| A.9 | oxadiargyl |
| A.10 | oxyfluorfen |
| A.11 | saflufenacil |
| A.12 | sulfentrazone |
| A.13 | ethyl [3-[2-chloro-4-fluoro-5-(1-methyl-6-trifluoromethyl-2,4-dioxo-1,2,3,4-tetra-hydropyrimidin-3-yl)phenoxy]-2-pyridyloxy] acetate (CAS 353292-31-6) |
| A.14 | 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) |

The PPO-inhibiting herbicides described above that are useful to carry out the present invention are often best applied in conjunction with one or more other herbicides to obtain control of a wider variety of undesirable vegetation. For example, PPO-inhibiting herbicides may further be used in conjunction with additional herbicides to which the crop plant is naturally tolerant, or to which it is resistant via expression of one or more additional transgenes as mentioned supra, or to which it is resistant via mutagenesis and breeding methods as described hereinafter. When used in conjunction with other targeting herbicides, the PPO-inhibiting herbicides, to which the plant of the present invention had been made resistant or tolerant, can be formulated with the other herbicide or herbicides, tank mixed with the other herbicide or herbicides, or applied sequentially with the other herbicide or herbicides.

Suitable components for mixtures are, for example, selected from the herbicides of class b1) to b15)

B) herbicides of class b1) to b15):

b1) lipid biosynthesis inhibitors;

b2) acetolactate synthase inhibitors (ALS inhibitors);

b3) photosynthesis inhibitors;

b4) protoporphyrinogen-IX oxidase inhibitors, b5) bleacher herbicides;

b6) enolpyruvyl shikimate 3-phosphate synthase inhibitors (EPSP inhibitors);

b7) glutamine synthetase inhibitors;

b8) 7,8-dihydropteroate synthase inhibitors (DHP inhibitors);

b9) mitosis inhibitors;

b10) inhibitors of the synthesis of very long chain fatty acids (VLCFA inhibitors);

b11) cellulose biosynthesis inhibitors;

b12) decoupler herbicides;

b13) auxinic herbicides;

b14) auxin transport inhibitors; and b15) other herbicides selected from the group consisting of bromobutide, chlorflurenol, chlorflurenol-methyl, cinmethylin, cumyluron, dalapon, dazomet, difenzoquat, difenzoquat-metilsulfate, dimethipin, DSMA, dymron, endothal and its salts, etobenzanid, flamprop, flamprop-isopropyl, flamprop-methyl, flamprop-M-isopropyl, flamprop-M-methyl, flurenol, flurenol-butyl, flurprimidol, fosamine, fosamine-ammonium, indanofan, indaziflam, maleic hydrazide, mefluidide, metam, methiozolin (CAS 403640-27-7), methyl azide, methyl bromide, methyl-dymron, methyl iodide, MSMA, oleic acid, oxaziclomefone, pelargonic acid, pyributicarb, quinoclamine, triaziflam, tridiphane and 6-chloro-3-(2-cyclopropyl-6-methylphenoxy)-4-pyridazinol (CAS 499223-49-3) and its salts and esters;

including their agriculturally acceptable salts or derivatives.

Examples of herbicides B which can be used in combination with the PPO-inhibiting herbicides according to the present invention are:

b1) from the group of the lipid biosynthesis inhibitors:

ACC-herbicides such as alloxydim, alloxydim-sodium, butroxydim, clethodim, clodinafop, clodinafop-propargyl, cycloxydim, cyhalofop, cyhalofop-butyl, diclofop, diclofop-methyl, fenoxaprop, fenoxaprop-ethyl, fenoxaprop-P, fenoxaprop-P-ethyl, fluazifop, fluazifop-butyl, fluazifop-P, fluazifop-P-butyl, haloxyfop, haloxyfop-methyl, haloxyfop-P, haloxyfop-P-methyl, metamifop, pinoxaden, profoxydim, propaquizafop, quizalofop, quizalofop-ethyl, quizalofop-tefuryl, quizalofop-P, quizalofop-P-ethyl, quizalofop-P-tefuryl, sethoxydim, tepraloxydim, tralkoxydim, 4-(4'-Chloro-4-cyclopropyl-2'-fluoro[1,1-biphenyl]-3-yl)-5-hydroxy-2,2,6,6-tetramethyl-2H-pyran-3(6H)-one (CAS 1312337-72-6); 4-(2',4'-Dichloro-4-cyclopropyl[1,1-biphenyl]-3-yl)-5-hydroxy-2,2,6,6-tetramethyl-2H-pyran-3(6H)-one (CAS 1312337-45-3); 4-(4'-Chloro-4-ethyl-2'-fluoro[1,1'-biphenyl]-3-yl)-5-hydroxy-2,2,6,6-tetramethyl-2H-pyran-3(6H)-one (CAS 1033757-93-5); 4-(2',4'-Dichloro-4-ethyl[1,1'-biphenyl]-3-yl)-2,2,6,6-tetramethyl-2H-pyran-3,5(4H,6H)-dione (CAS 1312340-84-3); 5-(Acetyloxy)-4-(4'-chloro-4-cyclopropyl-2'-fluoro[1,1-biphenyl]-3-yl)-3,6-dihydro-2,2,6,6-tetramethyl-2H-pyran-3-one (CAS 1312337-48-6); 5-(Acetyloxy)-4-(2',4'-dichloro-4-cyclopropyl-[1,1-biphenyl]-3-yl)-3,6-dihydro-2,2,6,6-tetramethyl-2H-pyran-3-one; 5-(Acetyloxy)-4-(4'-chloro-4-ethyl-2'-fluoro[1,1'-biphenyl]-3-yl)-3,6-dihydro-2,2,6,6-tetramethyl-2H-pyran-3-one (CAS 1312340-82-1); 5-(Acetyloxy)-4-(2',4'-dichloro-4-ethyl[1,1'-biphenyl]-3-yl)-3,6-dihydro-2,2,6,6-tetramethyl-2H-pyran-3-one (CAS 1033760-55-2); 4-(4'-Chloro-4-cyclopropyl-2'-fluoro[1,1'-biphenyl]-3-yl)-5,6-dihydro-2,2,6,6-tetramethyl-5-oxo-2H-pyran-3-yl carbonic acid methyl ester (CAS 1312337-51-1); 4-(2',4'-Dichloro-4-cyclopropyl-[1,1-biphenyl]-3-yl)-5,6-dihydro-2,2,6,6-tetramethyl-5-oxo-2H-pyran-3-yl carbonic acid methyl ester; 4-(4'-Chloro-4-ethyl-2'-fluoro[1,1-biphenyl]-3-yl)-5,6-dihydro-2,2,6,6-tetramethyl-5-oxo-2H-pyran-3-yl carbonic acid methyl ester (CAS 1312340-83-2); 4-(2',4'-Dichloro-4-ethyl[1,1-biphenyl]-3-yl)-5,6-dihydro-2,2,6,6-tetramethyl-5-oxo-2H-pyran-3-yl carbonic acid methyl ester (CAS 1033760-58-5); and non ACC herbicides such as benfuresate, butylate, cycloate, dalapon, dimepiperate, EPIC, esprocarb, ethofumesate, flupropanate, molinate, orbencarb, pebulate, prosulfocarb, TCA, thiobencarb, tiocarbazil, triallate and vernolate;

b2) from the group of the ALS inhibitors:

sulfonylureas such as amidosulfuron, azimsulfuron, bensulfuron, bensulfuron-methyl, chlorimuron, chlorimuron-ethyl, chlorsulfuron, cinosulfuron, cyclosulfamuron, ethametsulfuron, ethametsulfuron-methyl, ethoxysulfuron, flazasulfuron, flucetosulfuron, flupyrsulfuron, flupyrsulfuron-methyl-sodium, foramsulfuron, halosulfuron, halosulfuron-methyl, imazosulfuron, iodosulfuron, iodosulfuron-methyl-sodium, iofensulfuron, iofensulfuron-sodium, mesosulfuron, metazosulfuron, metsulfuron, metsulfuron-methyl, nicosulfuron, orthosulfamuron, oxasulfuron, primisulfuron, primisulfuron-methyl, propyrisulfuron, prosulfuron, pyrazosulfuron, pyrazosulfuron-ethyl, rimsulfuron, sulfometuron, sulfometuron-methyl, sulfosulfuron, thifensulfuron, thifensulfuron-methyl, triasulfuron, tribenuron, tribenuron-methyl, trifloxysulfuron, triflusulfuron, triflusulfuron-methyl and tritosulfuron, imidazolinones such as imazamethabenz, imazamethabenz-methyl, imazamox, imazapic, imazapyr, imazaquin and imazethapyr, triazolopyrimidine herbicides and sulfonanilides such as cloransulam, cloransulam-methyl, diclosulam, flumetsulam, florasulam, metosulam, penoxsulam, pyrimisulfan and pyroxsulam, pyrimidinylbenzoates such as bispyribac, bispyribac-sodium, pyribenzoxim, pyriftalid, pyriminobac, pyriminobac-methyl, pyrithiobac, pyrithiobac-sodium, 4-[[[2-[(4,6-dimethoxy-2-pyrimidinyl)oxy]phenyl]methyl]amino]-benzoic acid-1-methylethyl ester (CAS 420138-41-6), 4-[[[2-[(4,6-dimethoxy-2-pyrimidinyl)oxy]phenyl]methyl]amino]-benzoic acid propyl ester (CAS 420138-40-5), N-(4-bromophenyl)-2-[(4,6-dimethoxy-2-pyrimidinyl)oxy] benzenemethanamine (CAS 420138-01-8), sulfonylaminocarbonyl-triazolinone herbicides such as flucarbazone, flucarbazone-sodium, propoxycarbazone, propoxycarbazone-sodium, thiencarbazone and thiencarbazone-methyl; and triafamone;

among these, a preferred embodiment of the invention relates to those compositions comprising at least one imidazolinone herbicide;

b3) from the group of the photosynthesis inhibitors:

amicarbazone, inhibitors of the photosystem II, e.g. triazine herbicides, including of chlorotriazine, triazinones, triazindiones, methylthiotriazines and pyridazinones such as ametryn, atrazine, chloridazone, cyanazine, desmetryn, dimethametryn, hexazinone, metribuzin, prometon, prometryn, propazine, simazine, simetryn, terbumeton, terbuthylazin, terbutryn and trietazin, aryl urea such as chlorobromuron, chlorotoluron, chloroxuron, dimefuron, diuron, fluometuron, isoproturon, isouron, linuron, metamitron, methabenzthiazuron, metobenzuron, metoxuron, monolinuron, neburon, siduron, tebuthiuron and thiadiazuron, phenyl carbamates such as desmedipham, karbutilat, phenmedipham, phenmedipham-ethyl, nitrile herbicides such as bromofenoxim, bromoxynil and its salts and esters, ioxynil and its salts and esters, uraciles such as bromacil, lenacil and terbacil, and bentazon and bentazon-sodium, pyridate, pyridafol, pentanochlor and propanil and inhibitors of the photosystem I such as diquat, diquat-dibromide, paraquat, paraquat-dichloride and paraquat-dimetilsulfate. Among these, a preferred embodiment of the invention relates to those compositions comprising at least one aryl urea herbicide. Among these, likewise a preferred embodiment of the invention relates to those compositions comprising at least one triazine herbicide. Among these, likewise a preferred embodiment of the invention relates to those compositions comprising at least one nitrile herbicide;

b4) from the group of the protoporphyrinogen-IX oxidase inhibitors:

acifluorfen, acifluorfen-sodium, azafenidin, bencarbazone, benzfendizone, bifenox, butafenacil, carfentrazone, carfentrazone-ethyl, chlomethoxyfen, cinidon-ethyl, fluazolate, flufenpyr, flufenpyr-ethyl, flumiclorac, flumiclorac-pentyl, flumioxazin, fluoroglycofen, fluoroglycofen-ethyl, fluthiacet, fluthiacet-methyl, fomesafen, halosafen, lactofen, oxadiargyl, oxadiazon, oxyfluorfen, pentoxazone, profluazol, pyraclonil, pyraflufen, pyraflufen-ethyl, saflufenacil, sulfentrazone, thidiazimin, tiafenacil, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; 5-3100, N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethyl-phenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione, 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione (CAS 1304113-05-0), methyl (E)-4-[2-chloro-5-[4-chloro-5-(difluoromethoxy)-1H-methyl-pyrazol-3-yl]-4-fluoro-phenoxyl-3-methoxy-but-2-enoate [CAS 948893-00-3], and 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4);

b5) from the group of the bleacher herbicides:

PDS inhibitors: beflubutamid, diflufenican, fluridone, flurochloridone, flurtamone, norflurazon, picolinafen, and 4-(3-trifluoromethylphenoxy)-2-(4-trifluoromethylphenyl) pyrimidine (CAS 180608-33-7), HPPD inhibitors: benzobicyclon, benzofenap, clomazone, isoxaflutole, mesotrione, pyrasulfotole, pyrazolynate, pyrazoxyfen, sulcotrione, tefuryltrione, tembotrione, topramezone and bicyclopyrone, bleacher, unknown target: aclonifen, amitrole and flumeturon;

b6) from the group of the EPSP synthase inhibitors:

glyphosate, glyphosate-isopropylammonium, glyposate-potassium and glyphosate-trimesium (sulfosate);

b7) from the group of the glutamine synthase inhibitors:

bilanaphos (bialaphos), bilanaphos-sodium, glufosinate, glufosinate-P and glufosinate-ammonium;

b8) from the group of the DHP synthase inhibitors: asulam;

b9) from the group of the mitosis inhibitors:

compounds of group K1: dinitroanilines such as benfluralin, butralin, dinitramine, ethalfluralin, fluchloralin, oryzalin, pendimethalin, prodiamine and trifluralin, phosphoramidates such as amiprophos, amiprophos-methyl, and butamiphos, benzoic acid herbicides such as chlorthal, chlorthal-dimethyl, pyridines such as dithiopyr and thiazopyr, benzamides such as propyzamide and tebutam; compounds of group K2: chlorpropham, propham and carbetamide, among these, compounds of group K1, in particular dinitroanilines are preferred;

b10) from the group of the VLCFA inhibitors:

chloroacetamides such as acetochlor, alachlor, butachlor, dimethachlor, dimethenamid, dimethenamid-P, metazachlor, metolachlor, metolachlor-S, pethoxamid, pretilachlor, propachlor, propisochlor and thenylchlor, oxyacetanilides such as flufenacet and mefenacet, acetanilides such as diphenamid, naproanilide and napropamide, tetrazolinones such fentrazamide, and other herbicides such as anilofos, cafenstrole, fenoxasulfone, ipfencarbazone, piperophos, pyroxasulfone and isoxazoline compounds of the formulae II.1, II.2, II.3, II.4, II.5, II.6, II.7, II.8 and II.9

II.1

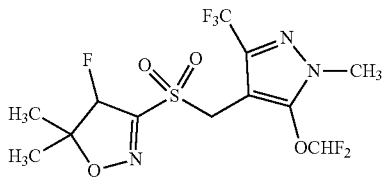

II.2

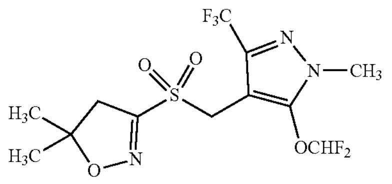

II.3

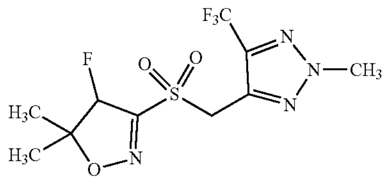

II.4

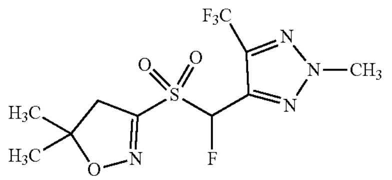

II.5

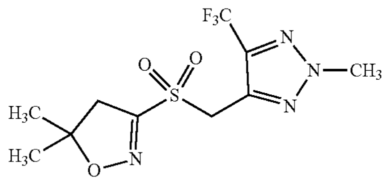

II.6

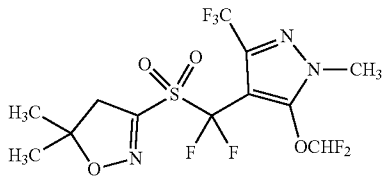

II.7

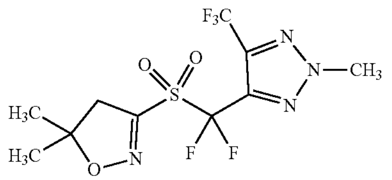

-continued

II.8

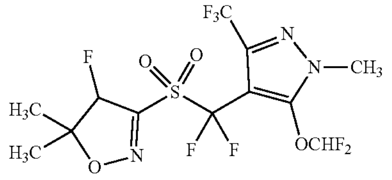

II.9

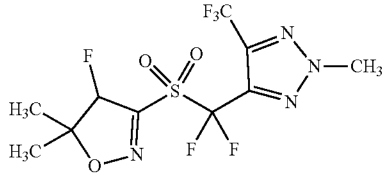

the isoxazoline compounds of the formula (I) I are known in the art, e.g. from WO 2006/024820, WO 2006/037945, WO 2007/071900 and WO 2007/096576;

among the VLCFA inhibitors, preference is given to chloroacetamides and oxyacetamides;

b11) from the group of the cellulose biosynthesis inhibitors:

chlorthiamid, dichlobenil, flupoxam, indaziflam, triaziflam, isoxaben and 1-Cyclohexyl-5-pentafluorphenyloxy-$1^4$-[1,2,4,6]thiatriazin-3-ylamine;

b12) from the group of the decoupler herbicides:

dinoseb, dinoterb and DNOC and its salts;

b13) from the group of the auxinic herbicides:

2,4-D and its salts and esters such as clacyfos, 2,4-DB and its salts and esters, aminocyclopyrachlor and its salts and esters, aminopyralid and its salts such as aminopyralid-tris (2-hydroxypropyl)ammonium and its esters, benazolin, benazolin-ethyl, chloramben and its salts and esters, clomeprop, clopyralid and its salts and esters, dicamba and its salts and esters, dichlorprop and its salts and esters, dichlorprop-P and its salts and esters, fluroxypyr, fluroxypyr-butometyl, fluroxypyr-meptyl, halauxifen and its salts and esters (CAS 943832-60-8); MCPA and its salts and esters, MCPA-thioethyl, MCPB and its salts and esters, mecoprop and its salts and esters, mecoprop-P and its salts and esters, picloram and its salts and esters, quinclorac, quinmerac, TBA (2,3,6) and its salts and esters and triclopyr and its salts and esters;

b14) from the group of the auxin transport inhibitors: diflufenzopyr, diflufenzopyr-sodium, naptalam and naptalam-sodium;

b15) from the group of the other herbicides: bromobutide, chlorflurenol, chlorflurenol-methyl, cinmethylin, cumyluron, cyclopyrimorate (CAS 499223-49-3) and its salts and esters, dalapon, dazomet, difenzoquat, difenzoquat-metilsulfate, dimethipin, DSMA, dymron, endothal and its salts, etobenzanid, flamprop, flamprop-isopropyl, flamprop-methyl, flamprop-M-isopropyl, flamprop-M-methyl, flurenol, flurenol-butyl, flurprimidol, fosamine, fosamine-ammonium, indanofan, indaziflam, maleic hydrazide, mefluidide, metam, methiozolin (CAS 403640-27-7), methyl azide, methyl bromide, methyl-dymron, methyl iodide, MSMA, oleic acid, oxaziclomefone, pelargonic acid, pyributicarb, quinoclamine, triaziflam and tridiphane.

Preferred herbicides B that can be used in combination with the PPO-inhibiting herbicides according to the present invention are:

b1) from the group of the lipid biosynthesis inhibitors:

clethodim, clodinafop-propargyl, cycloxydim, cyhalofop-butyl, diclofop-methyl, fenoxaprop-P-ethyl, fluazifop-P-butyl, haloxyfop-P-methyl, metamifop, pinoxaden, profoxydim, propaquizafop, quizalofop-P-ethyl, quizalofop-P-tefuryl, sethoxydim, tepraloxydim, tralkoxydim, 4-(4'-Chloro-4-cyclopropyl-2'-fluoro[1,1'-biphenyl]-3-yl)-5-hydroxy-2,2,6,6-tetramethyl-2H-pyran-3(6H)-one (CAS 1312337-72-6); 4-(2',4'-Dichloro-4-cyclopropyl[1,1-biphenyl]-3-yl)-5-hydroxy-2,2,6,6-tetramethyl-2H-pyran-3(6H)-one (CAS 1312337-45-3); 4-(4'-Chloro-4-ethyl-2'-fluoro[1,1-biphenyl]-3-yl)-5-hydroxy-2,2,6,6-tetramethyl-2H-pyran-3(6H)-one (CAS 1033757-93-5); 4-(2',4'-Dichloro-4-ethyl [1,1-biphenyl]-3-yl)-2,2,6,6-tetramethyl-2H-pyran-3,5(4H,6H)-dione (CAS 1312340-84-3); 5-(Acetyloxy)-4-(4'-chloro-4-cyclopropyl-2'-fluoro[1,1'-biphenyl]-3-yl)-3,6-dihydro-2,2,6,6-tetramethyl-2H-pyran-3-one (CAS 1312337-48-6); 5-(Acetyloxy)-4-(2',4'-dichloro-4-cyclopropyl-[1,1-biphenyl]-3-yl)-3,6-dihydro-2,2,6,6-tetramethyl-2H-pyran-3-one; 5-(Acetyloxy)-4-(4'-chloro-4-ethyl-2'-fluoro[1,1'-biphenyl]-3-yl)-3,6-dihydro-2,2,6,6-tetramethyl-2H-pyran-3-one (CAS 1312340-82-1); 5-(Acetyloxy)-4-(2',4'-dichloro-4-ethyl[1,1'-biphenyl]-3-yl)-3,6-dihydro-2,2,6,6-tetramethyl-2H-pyran-3-one (CAS 1033760-55-2); 4-(4'-Chloro-4-cyclopropyl-2'-fluoro[1,1'-biphenyl]-3-yl)-5,6-dihydro-2,2,6,6-tetramethyl-5-oxo-2H-pyran-3-yl carbonic acid methyl ester (CAS 1312337-51-1); 4-(2',4'-Dichloro-4-cyclopropyl-[1,1-biphenyl]-3-yl)-5,6-dihydro-2,2,6,6-tetramethyl-5-oxo-2H-pyran-3-yl carbonic acid methyl ester; 4-(4'-Chloro-4-ethyl-2'-fluoro[1,1-biphenyl]-3-yl)-5,6-dihydro-2,2,6,6-tetramethyl-5-oxo-2H-pyran-3-yl carbonic acid methyl ester (CAS 1312340-83-2); 4-(2',4'-Dichloro-4-ethyl[1,1-biphenyl]-3-yl)-5,6-dihydro-2,2,6,6-tetramethyl-5-oxo-2H-pyran-3-yl carbonic acid methyl ester (CAS 1033760-58-5); benfuresate, dimepiperate, EPIC, esprocarb, ethofumesate, molinate, orbencarb, prosulfocarb, thiobencarb and triallate;

b2) from the group of the ALS inhibitors:

amidosulfuron, azimsulfuron, bensulfuron-methyl, bispyribac-sodium, chlorimuron-ethyl, chlorsulfuron, cloransulam-methyl, cyclosulfamuron, diclosulam, ethametsulfuron-methyl, ethoxysulfuron, flazasulfuron, florasulam, flucarbazone-sodium, flucetosulfuron, flumetsulam, flupyrsulfuron-methyl-sodium, foramsulfuron, halosulfuron-methyl, imazamethabenz-methyl, imazamox, imazapic, imazapyr, imazaquin, imazethapyr, imazosulfuron, iodosulfuron, iodosulfuron-methyl-sodium, iofensulfuron, iofensulfuron-sodium, mesosulfuron, metazosulfuron, metosulam, metsulfuron-methyl, nicosulfuron, orthosulfamuron, oxasulfuron, penoxsulam, primisulfuron-methyl, propoxycarbazon-sodium, propyrisulfuron, prosulfuron, pyrazosulfuron-ethyl, pyribenzoxim, pyrimisulfan, pyriftalid, pyriminobac-methyl, pyrithiobac-sodium, pyroxsulam, rimsulfuron, sulfometuron-methyl, sulfosulfuron, thiencarbazone-methyl, thifensulfuron-methyl, triasulfuron, tribenuron-methyl, trifloxysulfuron, triflusulfuron-methyl, tritosulfuron and triafamone;

b3) from the group of the photosynthesis inhibitors:

ametryn, amicarbazone, atrazine, bentazone, bentazone-sodium, bromoxynil and its salts and esters, chloridazone, chlorotoluron, cyanazine, desmedipham, diquat-dibromide, diuron, fluometuron, hexazinone, ioxynil and its salts and esters, isoproturon, lenacil, linuron, metamitron, methabenzthiazuron, metribuzin, paraquat, paraquat-dichloride, phenmedipham, propanil, pyridate, simazine, terbutryn, terbuthylazine and thidiazuron;

b4) from the group of the protoporphyrinogen-IX oxidase inhibitors:

acifluorfen, acifluorfen-sodium, azafenidin, bencarbazone, benzfendizone, butafenacil, carfentrazone-ethyl, cinidon-ethyl, flufenpyr-ethyl, flumiclorac-pentyl, flumioxazin, fluoroglycofen-ethyl, fluthiacet-methyl, fomesafen, lactofen, oxadiargyl, oxadiazon, oxyfluorfen, pentoxazone, pyraflufen-ethyl, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxyl-acetate (CAS 353292-31-6; 5-3100), N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione; 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4- and 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4);

b5) from the group of the bleacher herbicides:

aclonifen, beflubutamid, benzobicyclon, clomazone, diflufenican, flurochloridone, flurtamone, isoxaflutole, mesotrione, norflurazon, picolinafen, pyrasulfotole, pyrazolynate, sulcotrione, tefuryltrione, tembotrione, topramezone, bicyclopyrone, 4-(3-trifluoromethylphenoxy)-2-(4-trifluoromethylphenyl)pyrimidine (CAS 180608-33-7), amitrole and flumeturon;

b6) from the group of the EPSP synthase inhibitors:

glyphosate, glyphosate-isopropylammonium, glyphosate-potassium and glyphosate-trimesium (sulfosate);

b7) from the group of the glutamine synthase inhibitors: glufosinate, glufosinate-P, glufosinate-ammonium;

b8) from the group of the DHP synthase inhibitors: asulam;

b9) from the group of the mitosis inhibitors:

benfluralin, dithiopyr, ethalfluralin, oryzalin, pendimethalin, thiazopyr and trifluralin;

b10) from the group of the VLCFA inhibitors:

acetochlor, alachlor, anilofos, butachlor, cafenstrole, dimethenamid, dimethenamid-P, fentrazamide, flufenacet, mefenacet, metazachlor, metolachlor, S-metolachlor, naproanilide, napropamide, pretilachlor, fenoxasulfone, ipfencarbazone, pyroxasulfone thenylchlor and isoxazoline-compounds of the formulae II.1, II.2, II.3, II.4, II.5, II.6, II.7, II.8 and II.9 as mentioned above;

b11) from the group of the cellulose biosynthesis inhibitors: dichlobenil, flupoxam, isoxaben and 1-Cyclohexyl-5-pentafluorphenyloxy-$1^4$-[1,2,4,6]thiatriazin-3-ylamine;

b13) from the group of the auxinic herbicides:

2,4-D and its salts and esters, aminocyclopyrachlor and its salts and esters, aminopyralid and its salts such as aminopyralid-tris(2-hydroxypropyl)ammonium and its esters, clopyralid and its salts and esters, dicamba and its salts and esters, dichlorprop-P and its salts and esters, fluroxypyr-meptyl, halauxifen and its salts and esters (CAS 943832-60-8), MCPA and its salts and esters, MCPB and its salts and esters, mecoprop-P and its salts and esters, picloram and its salts and esters, quinclorac, quinmerac and triclopyr and its salts and esters;

b14) from the group of the auxin transport inhibitors: diflufenzopyr and diflufenzopyr-sodium;

b15) from the group of the other herbicides: bromobutide, cinmethylin, cumyluron, cyclopyrimorate (CAS 499223-49-3) and its salts and esters, dalapon, difenzoquat, difenzoquat-metilsulfate, DSMA, dymron (=daimuron), flamprop, flamprop-isopropyl, flamprop-methyl, flamprop-M-isopropyl, flamprop-M-methyl, indanofan, indaziflam, metam, methylbromide, MSMA, oxaziclomefone, pyributicarb, triaziflam and tridiphane.

Particularly preferred herbicides B that can be used in combination with the PPO-inhibiting herbicides according to the present invention are:

b1) from the group of the lipid biosynthesis inhibitors: clodinafop-propargyl, cycloxydim, cyhalofop-butyl, fenoxaprop-P-ethyl, pinoxaden, profoxydim, tepraloxydim, tralkoxydim, 4-(4'-Chloro-4-cyclopropyl-2'-fluoro[1,1-biphenyl]-3-yl)-5-hydroxy-2,2,6,6-tetramethyl-2H-pyran-3(6H)-one (CAS 1312337-72-6); 4-(2',4'-Dichloro-4-cyclopropyl[1,1'-biphenyl]-3-yl)-5-hydroxy-2,2,6,6-tetramethyl-2H-pyran-3(6H)-one (CAS 1312337-45-3); 4-(4'-Chloro-4-ethyl-2'-fluoro[1,1-biphenyl]-3-yl)-5-hydroxy-2,2,6,6-tetramethyl-2H-pyran-3(6H)-one (CAS 1033757-93-5); 4-(2',4'-Dichloro-4-ethyl[1,1-biphenyl]-3-yl)-2,2,6,6-tetramethyl-2H-pyran-3,5(4H,6H)-dione (CAS 1312340-84-3); 5-(Acetyloxy)-4-(4'-chloro-4-cyclopropyl-2'-fluoro[1,1'-biphenyl]-3-yl)-3,6-dihydro-2,2,6,6-tetramethyl-2H-pyran-3-one (CAS 1312337-48-6); 5-(Acetyloxy)-4-(2',4'-dichloro-4-cyclopropyl-[1,1-biphenyl]-3-yl)-3,6-dihydro-2,2,6,6-tetramethyl-2H-pyran-3-one; 5-(Acetyloxy)-4-(4'-chloro-4-ethyl-2'-fluoro[1,1'-biphenyl]-3-yl)-3,6-dihydro-2,2,6,6-tetramethyl-2H-pyran-3-one (CAS 1312340-82-1); 5-(Acetyloxy)-4-(2',4'-dichloro-4-ethyl[1,1'-biphenyl]-3-yl)-3,6-dihydro-2,2,6,6-tetramethyl-2H-pyran-3-one (CAS 1033760-55-2); 4-(4'-Chloro-4-cyclopropyl-2'-fluoro[1,1'-biphenyl]-3-yl)-5,6-dihydro-2,2,6,6-tetramethyl-5-oxo-2H-pyran-3-yl carbonic acid methyl ester (CAS 1312337-51-1); 4-(2',4'-Dichloro-4-cyclopropyl-[1,1-biphenyl]-3-yl)-5,6-dihydro-2,2,6,6-tetramethyl-5-oxo-2H-pyran-3-yl carbonic acid methyl ester; 4-(4'-Chloro-4-ethyl-2'-fluoro[1,1-biphenyl]-3-yl)-5,6-dihydro-2,2,6,6-tetramethyl-5-oxo-2H-pyran-3-yl carbonic acid methyl ester (CAS 1312340-83-2); 4-(2',4'-Dichloro-4-ethyl[1,1-biphenyl]-3-yl)-5,6-dihydro-2,2,6,6-tetramethyl-5-oxo-2H-pyran-3-yl carbonic acid methyl ester (CAS 1033760-58-5); esprocarb, prosulfocarb, thiobencarb and triallate;

b2) from the group of the ALS inhibitors: bensulfuron-methyl, bispyribac-sodium, cyclosulfamuron, diclosulam, flumetsulam, flupyrsulfuron-methyl-sodium, foramsulfuron, imazamox, imazapic, imazapyr, imazaquin, imazethapyr, imazosulfuron, iodosulfuron, iodosulfuron-methyl-sodium, iofensulfuron, iofensulfuron-sodium, mesosulfuron, metazosulfuron, nicosulfuron, penoxsulam, propoxycarbazon-sodium, propyrisulfuron, pyrazosulfuron-ethyl, pyroxsulam, rimsulfuron, sulfosulfuron, thiencarbazon-methyl, tritosulfuron and triafamone;

b3) from the group of the photosynthesis inhibitors: ametryn, atrazine, diuron, fluometuron, hexazinone, isoproturon, linuron, metribuzin, paraquat, paraquat-dichloride, propanil, terbutryn and terbuthylazine;

b4) from the group of the protoporphyrinogen-IX oxidase inhibitors: acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), and 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione, and 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione;

b5) from the group of the bleacher herbicides: clomazone, diflufenican, flurochloridone, isoxaflutole, mesotrione, picolinafen, sulcotrione, tefuryltrione, tembotrione, topramezone, bicyclopyrone, amitrole and flumeturon;

b6) from the group of the EPSP synthase inhibitors: glyphosate, glyphosate-isopropylammonium and glyphosate-trimesium (sulfosate);

b7) from the group of the glutamine synthase inhibitors: glufosinate, glufosinate-P and glufosinate-ammonium;

b9) from the group of the mitosis inhibitors: pendimethalin and trifluralin;

b10) from the group of the VLCFA inhibitors: acetochlor, cafenstrole, dimethenamid-P, fentrazamide, flufenacet, mefenacet, metazachlor, metolachlor, S-metolachlor, fenoxasulfone, ipfencarbazone and pyroxasulfone; likewise, preference is given to isoxazoline compounds of the formulae II.1, II.2, II.3, II.4, II.5, II.6, II.7, II.8 and II.9 as mentioned above;

b11) from the group of the cellulose biosynthesis inhibitors: isoxaben;

b13) from the group of the auxinic herbicides: 2,4-D and its salts and esters such as clacyfos, and aminocyclopyrachlor and its salts and esters, aminopyralid and its salts and its esters, clopyralid and its salts and esters, dicamba and its salts and esters, fluroxypyr-meptyl, quinclorac and quinmerac;

b14) from the group of the auxin transport inhibitors: diflufenzopyr and diflufenzopyr-sodium, b15) from the group of the other herbicides: dymron (=daimuron), indanofan, indaziflam, oxaziclomefone and triaziflam.

Moreover, it may be useful to apply the PPO-inhibiting herbicides, when used in combination with a compound B described SUPRA, in combination with safeners. Safeners are chemical compounds which prevent or reduce damage on useful plants without having a major impact on the herbicidal action of herbicides towards unwanted plants. They can be applied either before sowings (e.g. on seed treatments, shoots or seedlings) or in the pre-emergence application or post-emergence application of the useful plant.

Furthermore, the safeners C, the PPO-inhibiting herbicides and/or the herbicides B can be applied simultaneously or in succession.

Suitable safeners are e.g. (quinolin-8-oxy)acetic acids, 1-phenyl-5-haloalkyl-1H-1,2,4-triazol-3-carboxylic acids, 1-phenyl-4,5-dihydro-5-alkyl-1H-pyrazol-3,5-dicarboxylic acids, 4,5-dihydro-5,5-diaryl-3-isoxazol carboxylic acids, dichloroacetamides, alpha-oximinophenylacetonitriles, acetophenonoximes, 4,6-dihalo-2-phenylpyrimidines, N-[[4-(aminocarbonyl)phenyl]sulfonyl]-2-benzoic amides, 1,8-naphthalic anhydride, 2-halo-4-(haloalkyl)-5-thiazol carboxylic acids, phosphorthiolates and N-alkyl-O-phenyl-carbamates and their agriculturally acceptable salts and their agriculturally acceptable derivatives such amides, esters, and thioesters, provided they have an acid group.

Examples of preferred safeners C are benoxacor, cloquintocet, cyometrinil, cyprosulfamide, dichlormid, dicyclonon, dietholate, fenchlorazole, fenclorim, flurazole, fluxofenim, furilazole, isoxadifen, mefenpyr, mephenate, naphthalic anhydride, oxabetrinil, 4-(dichloroacetyl)-1-oxa-4-azaspiro[4.5]decane (MON4660, CAS 71526-07-3) and 2,2,5-trimethyl-3-(dichloroacetyl)-1,3-oxazolidine (R-29148, CAS 52836-31-4).

Especially preferred safeners C are benoxacor, cloquintocet, cyprosulfamide, dichlormid, fenchlorazole, fenclorim, flurazole, fluxofenim, furilazole, isoxadifen, mefenpyr, naphthalic anhydride, oxabetrinil, 4-(dichloroacetyl)-1-oxa-4-azaspiro[4.5]decane (MON4660, CAS 71526-07-3) and 2,2,5-trimethyl-3-(dichloroacetyl)-1,3-oxazolidine (R-29148, CAS 52836-31-4).

Particularly preferred safeners C are benoxacor, cloquintocet, cyprosulfamide, dichlormid, fenchlorazole, fenclorim, furilazole, isoxadifen, mefenpyr, naphtalic anhydride, 4-(dichloroacetyl)-1-oxa-4-azaspiro[4.5]decane (MON4660, CAS 71526-07-3), and 2,2,5-trimethyl-3-(dichloroacetyl)-1,3-oxazolidine (R-29148, CAS 52836-31-4).

Also preferred safeners C are benoxacor, cloquintocet, cyprosulfamide, dichlormid, fenchlorazole, fenclorim, furilazole, isoxadifen, mefenpyr, 4-(dichloroacetyl)-1-oxa-4-azaspiro[4.5]decane (MON4660, CAS 71526-07-3) and 2,2,5-trimethyl-3-(dichloroacetyl)-1,3-oxazolidine (R-29148, CAS 52836-31-4).

Particularly preferred safeners C, which, as component C, are constituent of the composition according to the invention are the safeners C as defined above; in particular the safeners C.1-C.12 listed below in table C:

TABLE C

| Safener C |
|---|
| C.1 benoxacor |
| C.2 cloquintocet |
| C.3 cyprosulfamide |
| C.4 dichlormid |
| C.5 fenchlorazole |
| C.6 fenclorim |
| C.7 furilazole |
| C.8 isoxadifen |
| C.9 mefenpyr |
| C.10 naphtalic acid anhydride |
| C.11 4-(dichloroacetyl)-1-oxa-4-azaspiro[4.5]decane (MON4660, CAS 71526-07-3) |
| C.12 2,2,5-trimethyl-3-(dichloro-acetyl)-1,3-oxazolidine (R-29148, CAS 52836-31-4) |

The PPO-inhibiting herbicides (compounds A) and the active compounds B of groups b1) to b15) and the active compounds C are known herbicides and safeners, see, for example, The Compendium of Pesticide Common Names (http://www.alanwood.net/pesticides/); Farm Chemicals Handbook 2000 volume 86, Meister Publishing Company, 2000; B. Hock, C. Fedtke, R. R. Schmidt, Herbizide [Herbicides], Georg Thieme Verlag, Stuttgart 1995; W. H. Ahrens, Herbicide Handbook, 7th edition, Weed Science Society of America, 1994; and K. K. Hatzios, Herbicide Handbook, Supplement for the 7th edition, Weed Science Society of America, 1998. 2,2,5-Trimethyl-3-(dichloroacetyl)-1,3-oxazolidine [CAS No. 52836-31-4] is also referred to as R-29148. 4-(Dichloroacetyl)-1-oxa-4-azaspiro [4.5]decane [CAS No. 71526-07-3] is also referred to as AD-67 and MON 4660.

The assignment of the active compounds to the respective mechanisms of action is based on current knowledge. If several mechanisms of action apply to one active compound, this substance was only assigned to one mechanism of action.

Active compounds B and C having a carboxyl group can be employed in the form of the acid, in the form of an agriculturally suitable salt as mentioned above or else in the form of an agriculturally acceptable derivative in the compositions according to the invention.

In the case of dicamba, suitable salts include those, where the counterion is an agriculturally acceptable cation. For example, suitable salts of dicamba are dicamba-sodium, dicamba-potassium, dicamba-methylammonium, dicamba-dimethylammonium, dicamba-isopropylammonium, dicamba-diglycolamine, dicamba-olamine, dicamba-diolamine, dicamba-trolamine, dicamba-N,N-bis-(3-aminopropyl)methylamine and dicamba-diethylenetriamine. Examples of a suitable ester are dicamba-methyl and dicamba-butotyl.

Suitable salts of 2,4-D are 2,4-D-ammonium, 2,4-D-dimethylammonium, 2,4-D-diethylammonium, 2,4-D-diethanolammonium (2,4-D-diolamine), 2,4-D-triethanolammonium, 2,4-D-isopropylammonium, 2,4-D-triisopropanolammonium, 2,4-D-heptylammonium, 2,4-D-dodecylammonium, 2,4-D-tetradecylammonium, 2,4-D-triethylammonium, 2,4-D-tris(2-hydropropyl)ammonium, 2,4-D-tris(isopropyl)ammonium, 2,4-D-trolamine, 2,4-D-lithium, 2,4-D-sodium. Examples of suitable esters of 2,4-D are 2,4-D-butotyl, 2,4-D-2-butoxypropyl, 3-butoxypropyl, 2,4-D-butyl, 2,4-D-ethyl, 2,4-D-ethylhexyl, 2,4-D-isobutyl, 2,4-D-isooctyl, 2,4-D-isopropyl, 2,4-D-meptyl, 2,4-D-methyl, 2,4-D-octyl, 2,4-D-pentyl, 2,4-D-propyl, 2,4-D-tefuryl and clacyfos.

Suitable salts of 2,4-DB are for example 2,4-DB-sodium, 2,4-DB-potassium and 2,4-DB-dimethylammonium. Suitable esters of 2,4-DB are for example 2,4-DB-butyl and 2,4-DB-isoctyl.

Suitable salts of dichlorprop are for example dichlorprop-sodium, dichlorprop-potassium and dichlorprop-dimethylammonium. Examples of suitable esters of dichlorprop are dichlorprop-butotyl and dichlorprop-isoctyl.

Suitable salts and esters of MCPA include MCPA-butotyl, MCPA-butyl, MCPA-dimethylammonium, MCPA-diolamine, MCPA-ethyl, MCPA-thioethyl, MCPA-2-ethylhexyl, MCPA-isobutyl, MCPA-isoctyl, MCPA-isopropyl, MCPA-isopropylammonium, MCPA-methyl, MCPA-olamine, MCPA-potassium, MCPA-sodium and MCPA-trolamine.

A suitable salt of MCPB is MCPB sodium. A suitable ester of MCPB is MCPB-ethyl.

Suitable salts of clopyralid are clopyralid-potassium, clopyralid-olamine and clopyralid-tris-(2-hydroxypropyl) ammonium. Example of suitable esters of clopyralid is clopyralid-methyl.

Examples of a suitable ester of fluroxypyr are fluroxypyr-meptyl and fluroxypyr-2-butoxy-1-methylethyl, wherein fluroxypyr-meptyl is preferred.

Suitable salts of picloram are picloram-dimethylammonium, picloram-potassium, picloram-triisopropanolammonium, picloram-triisopropylammonium and picloram-trolamine. A suitable ester of picloram is picloram-isoctyl.

A suitable salt of triclopyr is triclopyr-triethylammonium. Suitable esters of triclopyr are for example triclopyr-ethyl and triclopyr-butotyl.

Suitable salts and esters of chloramben include chloramben-ammonium, chloramben-diolamine, chloramben-methyl, chloramben-methylammonium and chloramben-sodium. Suitable salts and esters of 2,3,6-TBA include 2,3,6-TBA-dimethylammonium, 2,3,6-TBA-lithium, 2,3,6-TBA-potassium and 2,3,6-TBA-sodium.

Suitable salts and esters of aminopyralid include aminopyralid-potassium and aminopyralid-tris(2-hydroxypropyl) ammonium.

Suitable salts of glyphosate are for example glyphosate-ammonium, glyphosate-diammonium, glyphoste-dimethylammonium, glyphosate-isopropylammonium, glyphosate-potassium, glyphosate-sodium, glyphosate-trimesium as well as the ethanolamine and diethanolamine salts, preferably glyphosate-diammonium, glyphosate-isopropylammonium and glyphosate-trimesium (sulfosate).

A suitable salt of glufosinate is for example glufosinate-ammonium.

A suitable salt of glufosinate-P is for example glufosinate-P-ammonium.

Suitable salts and esters of bromoxynil are for example bromoxynil-butyrate, bromoxynil-heptanoate, bromoxynil-octanoate, bromoxynil-potassium and bromoxynil-sodium.

Suitable salts and esters of ioxonil are for example ioxonil-octanoate, ioxonil-potassium and ioxonil-sodium.

Suitable salts and esters of mecoprop include mecoprop-butotyl, mecoprop-dimethylammonium, mecoprop-diolamine, mecoprop-ethadyl, mecoprop-2-ethylhexyl, mecoprop-isoctyl, mecoprop-methyl, mecoprop-potassium, mecoprop-sodium and mecoprop-trolamine.

Suitable salts of mecoprop-P are for example mecoprop-P-butotyl, mecoprop-P-dimethylammonium, mecoprop-P-2-ethylhexyl, mecoprop-P-isobutyl, mecoprop-P-potassium and mecoprop-P-sodium.

A suitable salt of diflufenzopyr is for example diflufenzopyr-sodium.

A suitable salt of naptalam is for example naptalam-sodium.

Suitable salts and esters of aminocyclopyrachlor are for example aminocyclopyrachlor-dimethylammonium, aminocyclopyrachlor-methyl, aminocyclopyrachlor-triisopropanolammonium, aminocyclopyrachlor-sodium and aminocyclopyrachlor-potassium.

A suitable salt of quinclorac is for example quinclorac-dimethylammonium.

A suitable salt of quinmerac is for example quinclorac-dimethylammonium.

A suitable salt of imazamox is for example imazamox-ammonium.

Suitable salts of imazapic are for example imazapic-ammonium and imazapic-isopropylammonium.

Suitable salts of imazapyr are for example imazapyr-ammonium and imazapyr-isopropylammonium.

A suitable salt of imazaquin is for example imazaquin-ammonium.

Suitable salts of imazethapyr are for example imazethapyr-ammonium and imazethapyr-isopropylammonium.

A suitable salt of topramezone is for example topramezone-sodium.

The preferred embodiments of the invention mentioned herein below have to be understood as being preferred either independently from each other or in combination with one another.

According to a preferred embodiment of the invention, the composition comprises as component B at least one, preferably exactly one herbicide B.

According to another preferred embodiment of the invention, the composition comprises at least two, preferably exactly two, herbicides B different from each other.

According to another preferred embodiment of the invention, the composition comprises at least three, preferably exactly three, herbicides B different from each other.

According to another preferred embodiment of the invention, the composition comprises as component A at least one, preferably exactly one PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl) phenoxy]-2-pyridyloxy]acetate (CAS 353292-31-6; S-3100; 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4] oxazin-6-yl)-1,3,5-triazinane-2,4-dione (CAS 1258836-72-4), and as component B at least one, preferably exactly one, herbicide B.

According to another preferred embodiment of the invention, the composition comprises as component A at least one, preferably exactly preferably exactly one PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4] oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), and at least two, preferably exactly two, herbicides B different from each other.

According to another preferred embodiment of the invention, the composition comprises as component A at least one, preferably exactly preferably exactly one PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; 5-3100), 1,5-dimethyl-6-thioxo-3-(2,2,7-trifluoro-3-oxo-4-(prop-2-ynyl)-3,4-dihydro-2H-benzo[b][1,4] oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) and at least three, preferably exactly three, herbicides B different from each other.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b1), in particular selected from the group consisting of clethodim, clodinafop-propargyl, cycloxydim, cyhalofop-butyl, fenoxaprop-P-ethyl, fluazifop, pinoxaden, profoxydim, quizalofop, sethoxydim, tepraloxydim, tralkoxydim, esprocarb, prosulfocarb, thiobencarb and triallate.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; 5-3100, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b2), in particular selected from the group consisting of bensulfuron-methyl, bispyribac-sodium, cloransulam-methyl, cyclosulfamuron, diclosulam, flumetsulam, flupyrsulfuron-methyl-sodium, foramsulfuron, halosulfuron-methyl, imazamox, imazapic, imazapyr, imazaquin, imazethapyr, imazosulfuron, iodosulfuron, iodosulfuron-methyl-sodium, mesosulfuron-methyl, metazosulfuron, nicosulfuron, penoxsulam, propoxycarbazon-sodium, pyrazosulfuron-ethyl, pyrithiobac-sodium, pyroxsulam, rimsulfuron, sulfosulfuron, thiencarbazon-methyl, thifensulfuron-methyl, trifloxysulfuron and tritosulfuron.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b3), in particular selected from the group consisting of ametryn, atrazine, bentazon, bromoxynil, diuron, fluometuron, hexazinone, isoproturon, linuron, metribuzin, paraquat, paraquat-dichloride, prometryne, propanil, terbutryn and terbuthylazine.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b4), in particular selected from the group consisting of acifluorfen, acifluorfen-sodium, azafenidin, bencarbazone, benzfendizone, bifenox, butafenacil, carfentrazone, carfentrazone-ethyl, chlomethoxyfen, cinidon-ethyl, fluazolate, flufenpyr, flufenpyr-ethyl, flumiclorac, flumiclorac-pentyl, flumioxazin, fluoroglycofen, fluoroglycofen-ethyl, fluthiacet, fluthiacet-methyl, fomesafen, halosafen, lactofen, oxadiargyl, oxadiazon, oxyfluorfen, pentoxazone, profluazol, pyraclonil, pyraflufen, pyraflufen-ethyl, saflufenacil, sulfentrazone, thidiazimin, tiafenacil, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), N-ethyl-3-(2,6-dichloro-4-trifluoromethylphenoxy)-5-methyl-1H-pyrazole-1-carboxamide (CAS 452098-92-9), N-tetrahydrofurfuryl-3-(2,6-dichloro-4-trifluoromethylphenoxy)-5-methyl-1H-pyrazole-1-carboxamide (CAS 915396-43-9), N-ethyl-3-(2-chloro-6-fluoro-4-trifluoromethylphenoxy)-5-methyl-1H-pyrazole-1-carboxamide (CAS 452099-05-7), N-tetrahydrofurfuryl-3-(2-chloro-6-fluoro-4-trifluoromethylphenoxy)-5-methyl-1H-pyrazole-1-carboxamide (CAS 452100-03-7), 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione, 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione, methyl (E)-4-[2-chloro-5-[4-chloro-5-(difluoromethoxy)-1H-methyl-pyrazol-3-yl]-4-fluoro-phenoxyl-3-methoxy-but-2-enoate [CAS 948893-00-3], 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4).

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b5), in particular selected from the group consisting of clomazone, diflufenican, flurochloridone, isoxaflutole, mesotrione, picolinafen, sulcotrione, tefuryltrione, tembotrione, topramezone, bicyclopyrone, amitrole and flumeturon.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b6), in particular selected from the group consisting of glyphosate, glyphosate-isopropylammonium and glyphosate-trimesium (sulfosate).

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b7), in particular selected from the group consisting of glufosinate, glufosinate-P and glufosinate-ammonium.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy] acetate (CAS 353292-31-6; S-3100, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b9), in particular selected from the group consisting of pendimethalin and trifluralin.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl(phenoxy]-2-pyridyloxy] acetate (CAS 353292-31-6; 5-3100, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4)), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b10), in particular selected from the group consisting of acetochlor, cafenstrole, dimethenamid-P, fentrazamide, flufenacet, mefenacet, metazachlor, metolachlor, S-metolachlor, fenoxasulfone and pyroxasulfone. Likewise, preference is given to compositions comprising in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; 5-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b10), in particular selected from the group consisting of isoxazoline compounds of the formulae II.1, II.2, II.3, II.4, II.5, II.6, II.7, II.8 and II.9, as defined above.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; 5-3100, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b13), in particular selected from the group consisting of 2,4-D and its salts and esters, aminocyclopyrachlor and its salts and esters, aminopyralid and its salts such as aminopyralid-tris(2-hydroxypropyl)ammonium and its esters, clopyralid and its salts and esters, dicamba and its salts and esters, fluroxypyr-meptyl, quinclorac and quinmerac.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b14), in particular selected from the group consisting of diflufenzopyr and diflufenzopyr-sodium.

According to another preferred embodiment of the invention, the composition comprises, in addition to a PPO-inhibiting herbicide, preferably acifluorfen, acifluorfen-sodium, butafenacil, cinidon-ethyl, carfentrazone-ethyl, flumioxazin, fluthiacet-methyl, fomesafen, lactofen, oxadiargyl, oxyfluorfen, saflufenacil, sulfentrazone, ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; S-3100), 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), especially preferred saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), at least one and especially exactly one herbicidally active compound from group b15), in particular selected from the group consisting of dymron (=daimuron), indanofan, indaziflam, oxaziclomefone and triaziflam.

Here and below, the term "binary compositions" includes compositions comprising one or more, for example 1, 2 or 3, active compounds of the PPO-inhibiting herbicide and either one or more, for example 1, 2 or 3, herbicides B.

In binary compositions comprising at least one PPO-inhibiting herbicide as component A and at least one herbicide B, the weight ratio of the active compounds A:B is generally in the range of from 1:1000 to 1000:1, preferably in the range of from 1:500 to 500:1, in particular in the range of from 1:250 to 250:1 and particularly preferably in the range of from 1:75 to 75:1.

Particularly preferred herbicides B are the herbicides B as defined above; in particular the herbicides B.1-B.229 listed below in table B:

TABLE B

| | Herbicide B |
|---|---|
| B.1 | clethodim |
| B.2 | clodinafop-propargyl |
| B.3 | cycloxydim |
| B.4 | cyhalofop-butyl |
| B.5 | fenoxaprop-ethy |
| B.6 | fenoxaprop-P-ethyl |
| B.7 | fluazifop |
| B.8 | metamifop |
| B.9 | pinoxaden |
| B.10 | profoxydim |
| B.11 | quizalofop |
| B.12 | sethoxydim |
| B.13 | tepraloxydim |
| B.14 | tralkoxydim |
| B.15 | esprocarb |
| B.16 | ethofumesate |
| B.17 | molinate |
| B.18 | prosulfocarb |
| B.19 | thiobencarb |
| B.20 | triallate |
| B.21 | bensulfuron-methyl |
| B.22 | bispyribac-sodium |
| B.23 | cloransulam-methyl |
| B.24 | chlorsulfuron |
| B.25 | clorimuron |
| B.26 | cyclosulfamuron |
| B.27 | diclosulam |
| B.28 | florasulam |
| B.29 | flumetsulam |
| B.30 | flupyrsulfuron-methyl-sodium |
| B.31 | fora msulfuron |
| B.32 | halosulfuron-methyl |
| B.33 | imazamox |
| B.34 | imazamox-ammonium |
| B.35 | imazapic |

TABLE B-continued

| | Herbicide B |
|---|---|
| B.36 | imazapic-ammonium |
| B.37 | imazapic-isopropylammonium |
| B.38 | imazapyr |
| B.39 | imazapyr-ammonium |
| B.40 | imazapyr-isopropylammonium |
| B.41 | imazaquin |
| B.42 | imazaquin-ammonium |
| B.43 | imazethapyr |
| B.44 | imazethapyr-ammonium |
| B.45 | imazethapyr-isopropylammonium |
| B.46 | imazosulfuron |
| B.47 | iodosulfuron-methyl-sodium |
| B.48 | iofensulfuron |
| B.49 | iofensulfuron-sodium |
| B.50 | mesosulfuron-methyl |
| B.51 | metazosulfuron |
| B.52 | metsulfuron-methyl |
| B.53 | metosulam |
| B.54 | nicosulfuron |
| B.55 | penoxsulam |
| B.56 | propoxycarbazon-sodium |
| B.57 | pyrazosulfuron-ethyl |
| B.58 | pyribenzoxim |
| B.59 | pyriftalid |
| B.60 | pyrithiobac-sodium |
| B.61 | pyroxsulam |
| B.62 | propyrisulfuron |
| B.63 | rimsulfuron |
| B.64 | sulfosulfuron |
| B.65 | thiencarbazone-methyl |
| B.66 | thifensulfuron-methyl |
| B.67 | tribenuron-methyl |
| B.68 | trifloxysulfuron |
| B.69 | tritosulfuron |
| B.70 | triafamone |
| B.71 | ametryne |
| B.72 | atrazine |
| B.73 | bentazon |
| B.74 | bromoxynil |
| B.75 | bromoxynil-octanoate |
| B.76 | bromoxynil-heptanoate |
| B.77 | bromoxynil-potassium |
| B.78 | diuron |
| B.79 | fluometuron |
| B.80 | hexazinone |
| B.81 | isoproturon |
| B.82 | linuron |
| B.83 | metamitron |
| B.84 | metribuzin |
| B.85 | prometryne |
| B.86 | propanil |
| B.87 | simazin |
| B.88 | terbuthylazine |
| B.89 | terbutryn |
| B.90 | paraquat-dichloride |
| B.91 | acifluorfen |
| B.92 | acifluorfen-sodium |
| B.93 | azafenidin |
| B.94 | bencarbazone |
| B.95 | benzfendizone |
| B.96 | bifenox |
| B.97 | butafenacil |
| B.98 | carfentrazone |
| B.99 | carfentrazone-ethyl |
| B.100 | chlomethoxyfen |
| B.101 | cinidon-ethyl |
| B.102 | fluazolate |
| B.103 | flufenpyr |
| B.104 | flufenpyr-ethyl |
| B.105 | flumiclorac |
| B.106 | flumiclorac-pentyl |
| B.107 | flumioxazin |
| B.108 | fluoroglycofen |
| B.109 | fluoroglycofen-ethyl |
| B.110 | fluthiacet |
| B.111 | fluthiacet-methy |
| B.112 | fomesafen |

TABLE B-continued

| | Herbicide B |
|---|---|
| B.113 | halosafen |
| B.114 | lactofen |
| B.115 | oxadiargyl |
| B.116 | oxadiazon |
| B.117 | oxyfluorfen |
| B.118 | pentoxazone |
| B.119 | profluazol |
| B.120 | pyraclonil |
| B.121 | pyraflufen |
| B.122 | pyraflufen-ethyl |
| B.123 | saflufenacil |
| B.124 | sulfentrazone |
| B.125 | thidiazimin |
| B.126 | tiafenacil |
| B.127 | ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6) |
| B.128 | 1,5-dimethyl-6-thioxo-3-(2,2,7-trifluoro-3-oxo-4-(prop-2-ynyl)-3,4-dihydro-2H-benzo[b][1,4]-oxazin-6-yl)-1,3,5-triazinane-2,4-dione (CAS 1258836-72-4) |
| B.129 | N-ethyl-3-(2,6-dichloro-4-trifluoromethylphenoxy)-5-methyl-1H-pyrazole-1-carboxamide (CAS 452098-92-9) |
| B.130 | N-tetrahydrofurfuryl-3-(2,6-dichloro-4-trifluoromethylphenoxy)-5-methyl-1H-pyrazole-1-carboxamide (CAS 915396-43-9) |
| B.131 | N-ethyl-3-(2-chloro-6-fluoro-4-trifluoromethylphenoxy)-5-methyl-1H-pyrazole-1-carboxamide (CAS 452099-05-7) |
| B.132 | N-tetrahydrofurfuryl-3-(2-chloro-6-fluoro-4-trifluoromethylphenoxy)-5-methyl-1H-pyrazole-1-carboxamide (CAS 452100-03-7) |
| | Herbicide B |
| B.133 | 3-[7-fluoro-3-oxo-4-(prop-2-dimethyl-6-thioxo-[1,3,5]triazinan-2,4-dione ynyl)-3,4-dihydro-2H-benzo[1,4]oxazin-6-yl]-1,5- |
| B.134 | 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione |
| B.135 | 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione |
| B.136 | methyl (E)-4-[2-chloro-5-[4-chloro-5-(difluoromethoxy)-1H-methyl-pyrazol-3-yl]-4-fluoro-phenoxy]-3-methoxy-but-2-enoate [CAS 948893-00-3] |
| B.137 | 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4) |
| B.138 | benzobicyclon |
| B.139 | clomazone |
| B.140 | diflufenican |
| B.141 | flurochloridone |
| B.142 | isoxaflutole |
| B.143 | mesotrione |
| B.144 | norflurazone |
| B.145 | picolinafen |
| B.146 | sulcotrione |

TABLE B-continued

| | Herbicide B |
|---|---|
| B.147 | tefuryltrione |
| B.148 | tembotrione |
| B.149 | topramezone |
| B.150 | topramezone-sodium |
| B.151 | bicyclopyrone |
| B.152 | amitrole |
| B.153 | fluometuron |
| B.154 | glyphosate |
| B.155 | glyphosate-ammonium |
| B.156 | glyphosate-dimethylammonium |
| B.157 | glyphosate-isopropylammonium |
| B.158 | glyphosate-trimesium (sulfosate) |
| B.159 | glyphosate-potassium |
| B.160 | glufosinate |
| B.161 | glufosinate-ammonium |
| B.162 | glufosinate-P |
| B.163 | glufosinate-P-ammonium |
| B.164 | pendimethalin |
| B.165 | trifluralin |
| B.166 | acetochlor |
| B.167 | butachlor |
| B.168 | cafenstrole |
| B.169 | dimethenamid-P |
| B.170 | fentrazamide |
| B.171 | flufenacet |
| B.172 | mefenacet |
| B.173 | metazachlor |
| B.174 | metolachlor |
| B.175 | S-metolachlor |
| B.176 | pretilachlor |
| B.177 | fenoxasulfone |
| B.178 | isoxaben |
| B.179 | ipfencarbazone |
| B.180 | pyroxasulfone |
| B.181 | 2,4-D |
| B.182 | 2,4-D-isobutyl |
| B.183 | 2,4-D-dimethylammonium |
| B.184 | 2,4-D-N,N,N-trimethylethanolammonium |
| B.185 | aminopyralid |
| B.186 | aminopyralid-methyl |
| B.187 | aminopyralid-tris(2-hydroxypropyl)ammonium |
| B.188 | clopyralid |
| B.189 | clopyralid-methyl |
| B.190 | clopyralid-olamine |
| B.191 | dicamba |
| B.192 | dicamba-butotyl |
| B.193 | dicamba-diglycolamine |
| B.194 | dicamba-dimethylammonium |
| B.195 | dicamba-diolamine |
| B.196 | dicamba-isopropylammonium |
| B.197 | dicamba-potassium |
| B.198 | dicamba-sodium |
| B.199 | dicamba-trolamine |
| B.200 | dicamba-N,N-bis-(3-aminopropyl)methylamine |
| B.201 | dicamba-diethylenetriamine |
| B.202 | fluroxypyr |
| B.203 | fluroxypyr-meptyl |
| B.204 | MCPA |
| B.205 | MCPA-2-ethylhexyl |
| B.206 | MCPA-dimethylammonium |
| B.207 | quinclorac |
| B.208 | quinclorac-dimethylammonium |
| B.209 | quinmerac |
| B.210 | quinmerac-dimethylammonium |
| B.211 | aminocyclopyrachlor |
| B.212 | aminocyclopyrachlor-potassium |
| B.213 | aminocyclopyrachlor-methyl |
| B.214 | diflufenzopyr |
| B.215 | diflufenzopyr-sodium |
| B.216 | dymron |
| B.217 | indanofan |
| B.218 | indaziflam |
| B.219 | oxaziclomefone |
| B.220 | triaziflam |
| B.221 | II.1 |
| B.222 | II.2 |
| B.223 | II.3 |
| B.224 | II.4 |
| B.225 | II.5 |
| B.226 | II.6 |
| B.227 | II.7 |
| B.228 | II.8 |
| B.229 | II.9 |

Particularly preferred are compositions 1.1 to 1.229, comprising acifluorfen and the substance(s) as defined in the respective row of table B-1:

TABLE B-1

| (compositions 1.1 to 1.229) | |
|---|---|
| comp. no. | herbicide B |
| 1.1 | B.1 |
| 1.2 | B.2 |
| 1.3 | B.3 |
| 1.4 | B.4 |
| 1.5 | B.5 |
| 1.6 | B.6 |
| 1.7 | B.7 |
| 1.8 | B.8 |
| 1.9 | B.9 |
| 1.10 | B.10 |
| 1.11 | B.11 |
| 1.12 | B.12 |
| 1.13 | B.13 |
| 1.14 | B.14 |
| 1.15 | B.15 |
| 1.16 | B.16 |
| 1.17 | B.17 |
| 1.18 | B.18 |
| 1.19 | B.19 |
| 1.20 | B.20 |
| 1.21 | B.21 |
| 1.22 | B.22 |
| 1.23 | B.23 |
| 1.24 | B.24 |
| 1.25 | B.25 |
| 1.26 | B.26 |
| 1.27 | B.27 |
| 1.28 | B.28 |
| 1.29 | B.29 |
| 1.30 | B.30 |
| 1.31 | B.31 |
| 1.32 | B.32 |
| 1.33 | B.33 |
| 1.34 | B.34 |
| 1.35 | B.35 |
| 1.36 | B.36 |
| 1.37 | B.37 |
| 1.38 | B.38 |
| 1.39 | B.39 |
| 1.40 | B.40 |
| 1.41 | B.41 |
| 1.42 | B.42 |
| 1.43 | B.43 |
| 1.44 | B.44 |
| 1.45 | B.45 |
| 1.46 | B.46 |
| 1.47 | B.47 |
| 1.48 | B.48 |
| 1.49 | B.49 |
| 1.50 | B.50 |
| 1.51 | B.51 |
| 1.52 | B.52 |
| 1.53 | B.53 |
| 1.54 | B.54 |

TABLE B-1-continued (compositions 1.1 to 1.229)

| comp. no. | herbi-cide B |
|---|---|
| 1.55 | B.55 |
| 1.56 | B.56 |
| 1.57 | B.57 |
| 1.58 | B.58. |
| 1.59 | B.59 |
| 1.60 | B.60 |
| 1.61 | B.61 |
| 1.62 | B.62 |
| 1.63 | B.63 |
| 1.64 | B.64 |
| 1.65 | B.65 |
| 1.66 | B.66 |
| 1.67 | B.67 |
| 1.68 | B.68 |
| 1.69 | B.69 |
| 1.70 | B.70 |
| 1.71 | B.71 |
| 1.72 | B.72 |
| 1.73 | B.73 |
| 1.74 | B.74 |
| 1.75 | B.75 |
| 1.76 | B.76 |
| 1.77 | B.77 |
| 1.78 | B.78 |
| 1.79 | B.79 |
| 1.80 | B.80 |
| 1.81 | B.81 |
| 1.82 | B.82 |
| 1.83 | B.83 |
| 1.84 | B.84 |
| 1.85 | B.85 |
| 1.86 | B.86 |
| 1.87 | B.87 |
| 1.88 | B.88 |
| 1.89 | B.89 |
| 1.90 | B.90 |
| 1.91 | B.91 |
| 1.92 | B.92 |
| 1.93 | B.93 |
| 1.94 | B.94 |
| 1.95 | B.95 |
| 1.96 | B.96 |
| 1.97 | B.97 |
| 1.98 | B.98 |
| 1.99 | B.99 |
| 1.100 | B.100 |
| 1.101 | B.101 |
| 1.102 | B.102 |
| 1.103 | B.103 |
| 1.104 | B.104 |
| 1.105 | B.105 |
| 1.106 | B.106 |
| 1.107 | B.107 |
| 1.108 | B.108 |
| 1.109 | B.109 |
| 1.110 | B.110 |
| 1.111 | B.111 |
| 1.112 | B.112 |
| 1.113 | B.113 |
| 1.114 | B.114 |
| 1.115 | B.115 |
| 1.116 | B.116 |
| 1.117 | B.117 |
| 1.118 | B.118 |
| 1.119 | B.119 |
| 1.120 | B.120 |
| 1.121 | B.121 |
| 1.122 | B.122 |
| 1.123 | B.123 |
| 1.124 | B.124 |
| 1.125 | B.125 |
| 1.126 | B.126 |
| 1.127 | B.127 |
| 1.128 | B.128 |
| 1.129 | B.129 |

TABLE B-1-continued (compositions 1.1 to 1.229)

| comp. no. | herbi-cide B |
|---|---|
| 1.130 | B.130 |
| 1.131 | B.131 |
| 1.132 | B.132 |
| 1.133 | B.133 |
| 1.134 | B.134 |
| 1.135 | B.135 |
| 1.136 | B.136 |
| 1.137 | B.137 |
| 1.138 | B.138 |
| 1.139 | B.139 |
| 1.140 | B.140 |
| 1.141 | B.141 |
| 1.142 | B.142 |
| 1.143 | B.143 |
| 1.144 | B.144 |
| 1.145 | B.145 |
| 1.146 | B.146 |
| 1.147 | B.147 |
| 1.148 | B.148 |
| 1.149 | B.149 |
| 1.150 | B.150 |
| 1.151 | B.151 |
| 1.152 | B.152 |
| 1.153 | B.153 |
| 1.154 | B.154 |
| 1.155 | B.155 |
| 1.156 | B.156 |
| 1.157 | B.157 |
| 1.158 | B.158 |
| 1.159 | B.159 |
| 1.160 | B.160 |
| 1.161 | B.161 |
| 1.162 | B.162 |
| 1.163 | B.163 |
| 1.164 | B.164 |
| 1.165 | B.165 |
| 1.166 | B.166 |
| 1.167 | B.167 |
| 1.168 | B.168 |
| 1.169 | B.169 |
| 1.170 | B.170 |
| 1.171 | B.171 |
| 1.172 | B.172 |
| 1.173 | B.173 |
| 1.174 | B.174 |
| 1.175 | B.175 |
| 1.176 | B.176 |
| 1.177 | B.177 |
| 1.178 | B.178 |
| 1.179 | B.179 |
| 1.180 | B.180 |
| 1.181 | B.181 |
| 1.182 | B.182 |
| 1.183 | B.183 |
| 1.184 | B.184 |
| 1.185 | B.185 |
| 1.186 | B.186 |
| 1.187 | B.187 |
| 1.188 | B.188 |
| 1.189 | B.189 |
| 1.190 | B.190 |
| 1.191 | B.191 |
| 1.192 | B.192 |
| 1.193 | B.193 |
| 1.194 | B.194 |
| 1.195 | B.195 |
| 1.196 | B.196 |
| 1.197 | B.197 |
| 1.198 | B.198 |
| 1.199 | B.199 |
| 1.200 | B.200 |
| 1.201 | B.201 |
| 1.202 | B.202 |
| 1.203 | B.203 |
| 1.204 | B.204 |

TABLE B-1-continued

| (compositions 1.1 to 1.229) | |
|---|---|
| comp. no. | herbi-cide B |
| 1.205 | B.205 |
| 1.206 | B.206 |
| 1.207 | B.207 |
| 1.208 | B.208 |
| 1.209 | B.209 |
| 1.210 | B.210 |
| 1.211 | B.211 |
| 1.212 | B.212 |
| 1.213 | B.213 |
| 1.214 | B.214 |
| 1.215 | B.215 |
| 1.216 | B.216 |
| 1.217 | B.217 |
| 1.218 | B.218 |
| 1.219 | B.219 |
| 1.220 | B.220 |
| 1.221 | B.221 |
| 1.222 | B.222 |
| 1.223 | B.223 |
| 1.224 | B.224 |
| 1.225 | B.225 |
| 1.226 | B.226 |
| 1.227 | B.227 |
| 1.228 | B.228 |
| 1.229 | B.229 |

Also especially preferred are compositions 2.1. to 2.229 which differ from the corresponding compositions 1.1 to 1.229 only in that they comprise as component A acifluorfen-sodium.

Also especially preferred are compositions 3.1. to 3.229 which differ from the corresponding compositions 1.1 to 1.229 only in that they comprise as component A azafenidin.

Also especially preferred are compositions 4.1. to 4.229 which differ from the corresponding compositions 1.1 to 1.229 only in that they comprise as component A bencarbazone.

Also especially preferred are compositions 5.1. to 5.229 which differ from the corresponding compositions 1.1 to 1.229 only in that they comprise as component A benzfendizone.

Also especially preferred are compositions 6.1. to 6.229 which differ from the corresponding compositions 1.1 to 1.229 only in that they comprise as component A bifenox.

Also especially preferred are compositions 7.1. to 7.229 which differ from the corresponding compositions 1.1 to 1.227 only in that they comprise as component A butafenacil.

Also especially preferred are compositions 8.1. to 8.229 which differ from the corresponding compositions 1.1 to 1.229 only in that they comprise as component A carfentrazone.

Also especially preferred are compositions 9.1. to 9.229 which differ from the corresponding compositions 1.1 to 1.229 only in that they comprise as component A carfentrazone-ethyl.

Also especially preferred are compositions 10.1. to 10.229 which differ from the corresponding compositions 1.1 to 1.229 only in that they comprise as component A chlomethoxyfen.

Also especially preferred are compositions 11.1. to 11.229 which differ from the corresponding compositions 1.1 to 1.229 only in that they comprise as component A cinidon-ethyl.

Also especially preferred are compositions 12.1. to 12.229 which differ from the corresponding compositions 1.1 to 1.229 only in that they comprise as component A fluazolate.

Also especially preferred are compositions 13.1. to 13.229 which differ from the corresponding compositions 1.1 to 1.229 only in that they comprise as component A flufenpyr.

Also especially preferred are compositions 14.1 to 14.229 which differ from the corresponding compositions 1.1 to 1.229 only in that they comprise as component A flufenpyr-ethyl.

Also especially preferred are compositions 15.1. to 15.229 which differ from the corresponding compositions 1.1 to 1.229 only in that they comprise as component A flumiclorac.

Also especially preferred are compositions 16.1. to 16.229 which differ from the corresponding compositions 1.1 to 1.229 only in that they comprise as component A flumiclorac-pentyl.

Also especially preferred are compositions 17.1. to 17.229 which differ from the corresponding compositions 1.1 to 1.229 only in that they comprise as component A flumioxazin.

Also especially preferred are compositions 18.1. to 18.229 which differ from the corresponding compositions 1.1 to 1.229 only in that they comprise as component A fluoroglycofen.

Also especially preferred are compositions 19.1. to 19.229 which differ from the corresponding compositions 1.1 to 1.229 only in that they comprise as component A fluoroglycofen-ethyl.

Also especially preferred are compositions 20.1. to 20.229 which differ from the corresponding compositions 1.1 to 1.229 only in that they comprise as component A fluthiacet.

Also especially preferred are compositions 21.1. to 21.229 which differ from the corresponding compositions 1.1 to 1.229 only in that they comprise as component A fluthiacet-methyl.

Also especially preferred are compositions 22.1. to 22.229 which differ from the corresponding compositions 1.1 to 1.229 only in that they comprise as component A fomesafen.

Also especially preferred are compositions 23.1. to 23.229 which differ from the corresponding compositions 1.1 to 1.229 only in that they comprise as component A halosafen.

Also especially preferred are compositions 24.1. to 24.229 which differ from the corresponding compositions 1.1 to 1.229 only in that they comprise as component A lactofen.

Also especially preferred are compositions 25.1. to 25.229 which differ from the corresponding compositions 1.1 to 1.229 only in that they comprise as component A oxadiargyl.

Also especially preferred are compositions 26.1. to 26.229 which differ from the corresponding compositions 1.1 to 1.229 only in that they comprise as component A oxadiazon.

Also especially preferred are compositions 27.1. to 27.229 which differ from the corresponding compositions 1.1 to 1.229 only in that they comprise as component A oxyfluorfen.

Also especially preferred are compositions 28.1. to 28.229 which differ from the corresponding compositions 1.1 to 1.229 only in that they comprise as component A pentoxazone.

Also especially preferred are compositions 29.1. to 29.229 which differ from the corresponding compositions 1.1 to 1.229 only in that they comprise as component A profluazol.

Also especially preferred are compositions 30.1. to 30.229 which differ from the corresponding compositions 1.1 to 1.229 only in that they comprise as component A pyraclonil.

Also especially preferred are compositions 31.1. to 31.229 which differ from the corresponding compositions 1.1 to 1.229 only in that they comprise as component A pyraflufen.

Also especially preferred are compositions 32.1. to 32.229 which differ from the corresponding compositions 1.1 to 1.229 only in that they comprise as component A pyraflufen-ethyl.

Also especially preferred are compositions 33.1. to 33.229 which differ from the corresponding compositions 1.1 to 1.229 only in that they comprise as component A saflufenacil.

Also especially preferred are compositions 34.1. to 34.229 which differ from the corresponding compositions 1.1 to 1.229 only in that they comprise as component A sulfentrazone.

Also especially preferred are compositions 35.1. to 35.229 which differ from the corresponding compositions 1.1 to 1.229 only in that they comprise as component A thidiazimin.

Also especially preferred are compositions 36.1. to 36.229 which differ from the corresponding compositions 1.1 to 1.229 only in that they comprise as component A tiafenacil.

Also especially preferred are compositions 37.1. to 37.229 which differ from the corresponding compositions 1.1 to 1.229 only in that they comprise as component A ethyl [3-[2-chloro-4-fluoro-5-(1-methyl-6-trifluoromethyl-2,4-dioxo-1,2,3,4-tetrahydropyrimidin-3-yl)phenoxy]-2-pyridyloxy]acetate (CAS 353292-31-6; 5-3100).

Also especially preferred are compositions 38.1. to 38.229 which differ from the corresponding compositions 1.1 to 1.229 only in that they comprise as component A 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4)

Also especially preferred are compositions 39.1. to 39.229 which differ from the corresponding compositions 1.1 to 1.229 only in that they comprise as component A N-ethyl-3-(2,6-dichloro-4-trifluoromethylphenoxy)-5-methyl-1H-pyrazole-1-carboxamide (CAS 452098-92-9).

Also especially preferred are compositions 40.1. to 40.229 which differ from the corresponding compositions 1.1 to 1.229 only in that they comprise as component A N-tetrahydrofurfuryl-3-(2,6-dichloro-4-trifluoromethylphenoxy)-5-methyl-1H-pyrazole-1-carboxamide (CAS 915396-43-9).

Also especially preferred are compositions 41.1. to 41.229 which differ from the corresponding compositions 1.1 to 1.229 only in that they comprise as component A N-ethyl-3-(2-chloro-6-fluoro-4-trifluoromethylphenoxy)-5-methyl-1H-pyrazole-1-carboxamide (CAS 452099-05-7).

Also especially preferred are compositions 42.1. to 42.229 which differ from the corresponding compositions 1.1 to 1.229 only in that they comprise as component A N-tetrahydrofurfuryl-3-(2-chloro-6-fluoro-4-trifluoromethylphenoxy)-5-methyl-1H-pyrazole-1-carboxamide (CAS 452100-03-7).

Also especially preferred are compositions 43.1. to 43.229 which differ from the corresponding compositions 1.1 to 1.229 only in that they comprise as component A 3-[7-fluoro-3-oxo-4-(prop-2-ynyl)-3,4-dihydro-2H-benzo[1,4]oxazin-6-yl]-1,5-dimethyl-6-thioxo-[1,3,5]triazinan-2,4-dione.

Also especially preferred are compositions 44.1. to 44.229 which differ from the corresponding compositions 1.1 to 1.229 only in that they comprise as component A methyl (E)-4-[2-chloro-5-[4-chloro-5-(difluoromethoxy)-1H-methyl-pyrazol-3-yl]-4-fluoro-phenoxyl-3-methoxy-but-2-enoate (CAS 948893-00-3).

Also especially preferred are compositions 45.1. to 45.229 which differ from the corresponding compositions 1.1 to 1.229 only in that they comprise as component A 3-[7-Chloro-5-fluoro-2-(trifluoromethyl)-1H-benzimidazol-4-yl]-1-methyl-6-(trifluoromethyl)-1H-pyrimidine-2,4-dione (CAS 212754-02-4).

Also especially preferred are compositions 46.1. to 46.229 which differ from the corresponding compositions 1.1 to 1.229 only in that they comprise as component A 2-(2,2,7-Trifluoro-3-oxo-4-prop-2-ynyl-3,4-dihydro-2H-benzo[1,4]oxazin-6-yl)-4,5,6,7-tetrahydro-isoindole-1,3-dione.

Also especially preferred are compositions 47.1. to 47.229 which differ from the corresponding compositions 1.1 to 1.229 only in that they comprise as component A 1-Methyl-6-trifluoromethyl-3-(2,2,7-trifluoro-3-oxo-4-prop-2-ynyl-3,4-dihydro-2H-benzo[1,4]oxazin-6-yl)-1H-pyrimidine-2,4-dione Also especially preferred are compositions 48.1. to 48.229 which differ from the corresponding compositions 1.1 to 1.229 only in that they additionally comprise benoxacor as safener C.

Also especially preferred are compositions 49.1. to 49.229 which differ from the corresponding compositions 1.1 to 1.229 only in that they additionally comprise cloquintocet as safener C.

Also especially preferred are compositions 50.1. to 50.229 which differ from the corresponding compositions 1.1 to 1.229 only in that they additionally comprise cyprosulfamide as safener C.

Also especially preferred are compositions 51.1. to 51.229 which differ from the corresponding compositions 1.1 to 1.229 only in that they additionally comprise dichlormid as safener C.

Also especially preferred are compositions 52.1. to 52.229 which differ from the corresponding compositions 1.1 to 1.229 only in that they additionally comprise fenchlorazole as safener C.

Also especially preferred are compositions 53.1. to 53.229 which differ from the corresponding compositions 1.1 to 1.229 only in that they additionally comprise fenclorim as safener C.

Also especially preferred are compositions 54.1. to 54.229 which differ from the corresponding compositions 1.1 to 1.229 only in that they additionally comprise furilazole as safener C.

Also especially preferred are compositions 55.1. to 55.229 which differ from the corresponding compositions 1.1 to 1.229 only in that they additionally comprise isoxadifen as safener C.

Also especially preferred are compositions 56.1. to 56.229 which differ from the corresponding compositions 1.1 to 1.229 only in that they additionally comprise mefenpyr as safener C.

Also especially preferred are compositions 57.1. to 57.229 which differ from the corresponding compositions 1.1 to 1.229 only in that they additionally comprise 4-(dichloroacetyl)-1-oxa-4-azaspiro[4.5]decane (MON4660, CAS 71526-07-3) as safener C.

Also especially preferred are compositions 58.1. to 58.229 which differ from the corresponding compositions 1.1 to 1.229 only in that they additionally comprise 2,2,5-trimethyl-3-(dichloroacetyl)-1,3-oxazolidine (R-29148, CAS 52836-31-4) as safener C.

It is generally preferred to use the compounds of the invention in combination with herbicides that are selective for the crop being treated and which complement the spectrum of weeds controlled by these compounds at the application rate employed. It is further generally preferred to apply the compounds of the invention and other complementary herbicides at the same time, either as a combination formulation or as a tank mix.

It is recognized that the polynucleotide molecules and polypeptides of the invention encompass polypeptides comprising an amino acid sequence that is sufficiently identical to the amino acid sequences set forth in SEQ ID Nos: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313. The term “sufficiently identical” is used herein to refer to a first amino acid or nucleotide sequence that contains a sufficient or minimum number of identical or equivalent (e.g., with a similar side chain) amino acid residues or nucleotides to a second amino acid or nucleotide sequence such that the first and second amino acid or nucleotide sequences have a common structural domain and/or common functional activity.

Generally, “sequence identity” refers to the extent to which two optimally aligned DNA or amino acid sequences are invariant throughout a window of alignment of components, e.g., nucleotides or amino acids. An “identity fraction” for aligned segments of a test sequence and a reference sequence is the number of identical components that are shared by the two aligned sequences divided by the total number of components in reference sequence segment, i.e., the entire reference sequence or a smaller defined part of the reference sequence. “Percent identity” is the identity fraction times 100. Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and preferably by computerized implementations of these algorithms such as GAP, BESTFIT, FASTA, and TFASTA available as part of the GCG. Wisconsin Package. (Accelrys Inc. Burlington, Mass.)

Polynucleotides and Oligonucleotides

By an “isolated polynucleotide”, including DNA, RNA, or a combination of these, single or double stranded, in the sense or antisense orientation or a combination of both, dsRNA or otherwise, we mean a polynucleotide which is at least partially separated from the polynucleotide sequences with which it is associated or linked in its native state. That means other nucleic acid molecules are present in an amount less than 5% based on weight of the amount of the desired nucleic acid, preferably less than 2% by weight, more preferably less than 1% by weight, most preferably less than 0.5% by weight. Preferably, an “isolated” nucleic acid is free of some of the sequences that naturally flank the nucleic acid (i.e., sequences located at the 5' and 3' ends of the nucleic acid) in the genomic DNA of the organism from which the nucleic acid is derived. For example, in various embodiments, the isolated herbicide resistance and/or tolerance related protein encoding nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived. Moreover, an “isolated” nucleic acid molecule, such as a cDNA molecule, can be free from some of the other cellular material with which it is naturally associated, or culture medium when produced by recombinant techniques, or chemical precursors or other chemicals when chemically synthesized. Preferably, the isolated polynucleotide is at least 60% free, preferably at least 75% free, and most preferably at least 90% free from other components with which they are naturally associated. As the skilled addressee would be aware, an isolated polynucleotide can be an exogenous polynucleotide present in, for example, a transgenic organism which does not naturally comprise the polynucleotide. Furthermore, the terms “polynucleotide(s)”, “nucleic acid sequence(s)”, “nucleotide sequence(s)”, “nucleic acid(s)”, “nucleic acid molecule” are used interchangeably herein and refer to nucleotides, either ribonucleotides or deoxyribonucleotides or a combination of both, in a polymeric unbranched form of any length.

The term “mutated PPO nucleic acid” refers to a PPO nucleic acid having a sequence that is mutated from a wild-type PPO nucleic acid, such as e.g. SEQ ID NO: 302, 303, 304, 305, 306, 307, 308, 309, 310, 311, 314, or homologues, paralogues and orthologues thereof; and that confers increased PPO-inhibiting herbicide tolerance to a plant in which it is expressed. Furthermore, the term “mutated protoporphyrinogen oxidase (mutated PPO)” refers to the replacement of an amino acid of the wild-type primary sequences SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313 or a variant, a derivative, a homologue, an orthologue, or paralogue thereof, with another amino acid. The expression "mutated amino acid" will be used below to designate the amino acid which is replaced by another amino acid, thereby designating the site of the mutation in the primary sequence of the protein.

In a preferred embodiment, the PPO nucleotide sequence encoding a mutated PPO comprises the sequence of SEQ ID NO: 302, 303, 304, 305, 306, 307, 308, 309, 310, 311, 314, or a variant or derivative thereof.

Furthermore, it will be understood by the person skilled in the art that the PPO nucleotide sequences encompass homologues, paraloques and orthologues of SEQ ID NO 302, 303, 304, 305, 306, 307, 308, 309, 310, 311, 314, as defined hereinafter.

The term "variant" with respect to a sequence (e.g., a polypeptide or nucleic acid sequence such as—for example—a transcription regulating nucleotide sequence of the invention) is intended to mean substantially similar sequences. For nucleotide sequences comprising an open reading frame, variants include those sequences that, because of the degeneracy of the genetic code, encode the identical amino acid sequence of the native protein. Naturally occurring allelic variants such as these can be identified with the use of well-known molecular biology techniques, as, for example, with polymerase chain reaction (PCR) and hybridization techniques. Variant nucleotide sequences also include synthetically derived nucleotide sequences, such as those generated, for example, by using site-directed mutagenesis and for open reading frames, encode the native protein, as well as those that encode a polypeptide having amino acid substitutions relative to the native protein, e.g. the mutated PPO according to the present invention as disclosed herein. Generally, nucleotide sequence variants of the invention will have at least 30, 40, 50, 60, to 70%, e.g., preferably 71%, 72%, 73%, 74%, 75%, 76%, 77%, 78%, to 79%, generally at least 80%, e.g., 81%-84%, at least 85%, e.g., 86%, 87%, 88%, 89%, 90%, 91%, 92%, 93%, 94%, 95%, 96%, 97%, to 98% and 99% nucleotide "sequence identity" to the nucleotide sequence encoding a polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313. The % identity of a polynucleotide is determined by GAP (Needleman and Wunsch, 1970) analysis (GCG program) with a gap creation penalty=5, and a gap extension penalty=0.3. Unless stated otherwise, the query sequence is at least 45 nucleotides in length, and the GAP analysis aligns the two sequences over a region of at least 45 nucleotides. Preferably, the query sequence is at least 150 nucleotides in length, and the GAP analysis aligns the two sequences over a region of at least 150 nucleotides. More preferably, the query sequence is at least 300 nucleotides in length and the GAP analysis aligns the two sequences over a region of at least 300 nucleotides. Even more preferably, the GAP analysis aligns the two sequences over their entire length.

Polypeptides

By "substantially purified polypeptide" or "purified" a polypeptide is meant that has been separated from one or more lipids, nucleic acids, other polypeptides, or other contaminating molecules with which it is associated in its native state. It is preferred that the substantially purified polypeptide is at least 60% free, more preferably at least 75% free, and more preferably at least 90% free from other components with which it is naturally associated. As the skilled addressee will appreciate, the purified polypeptide can be a recombinantly produced polypeptide. The terms "polypeptide" and "protein" are generally used interchangeably and refer to a single polypeptide chain which may or may not be modified by addition of non-amino acid groups. It would be understood that such polypeptide chains may associate with other polypeptides or proteins or other molecules such as co-factors. The terms "proteins" and "polypeptides" as used herein also include variants, mutants, modifications, analogous and/or derivatives of the polypeptides of the invention as described herein.

The % identity of a polypeptide is determined by GAP (Needleman and Wunsch, 1970) analysis (GCG program) with a gap creation penalty=5, and a gap extension penalty=0.3. The query sequence is at least 25 amino acids in length, and the GAP analysis aligns the two sequences over a region of at least 25 amino acids. More preferably, the query sequence is at least 50 amino acids in length, and the GAP analysis aligns the two sequences over a region of at least 50 amino acids. More preferably, the query sequence is at least 100 amino acids in length and the GAP analysis aligns the two sequences over a region of at least 100 amino acids. Even more preferably, the query sequence is at least 250 amino acids in length and the GAP analysis aligns the two sequences over a region of at least 250 amino acids. Even more preferably, the GAP analysis aligns the two sequences over their entire length.

With regard to a defined polypeptide, it will be appreciated that % identity figures higher than those provided above will encompass preferred embodiments. Thus, where applicable, in light of the minimum % identity figures, it is preferred that the PPO polypeptide of the invention comprises an amino acid sequence which is at least 40%, more preferably at least 45%, more preferably at least 50%, more preferably at least 55%, more preferably at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313.

By "variant" polypeptide is intended a polypeptide derived from the protein of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, by deletion (so-called truncation) or addition of one or more amino acids to the N-terminal and/or C-terminal end of the native protein; deletion or addition of one or more amino acids at one or more sites in the native protein; or substitution of one or more amino acids at one or more sites in the native protein. Such variants may result from, for example, genetic polymorphism or from human manipulation. Methods for such manipulations are generally known in the art.

"Derivatives" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide and may range from 1 to 10 amino acids; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds).

TABLE 1

Examples of conserved amino acid substitutions

| Residue | Conservative Substitutions |
|---|---|
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | He; Val |
| Lys | Arg; Gln |
| Met | Leu; Ile |
| Phe | Met; Leu; Tyr |
| Ser | Thr; Gly |

TABLE 1-continued

| Examples of conserved amino acid substitutions | |
|---|---|
| Residue | Conservative Substitutions |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, OH), QuickChange Site Directed mutagenesis (Stratagene, San Diego, CA), PCR-mediated site-directed mutagenesis or other site-directed mutagenesis protocols.

"Derivatives" further include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

"Orthologues" and "paralogues" encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

It is well-known in the art that paralogues and orthologues may share distinct domains harboring suitable amino acid residues at given sites, such as binding pockets for particular substrates or binding motifs for interaction with other proteins.

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788(2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol 147(1); 195-7).

The inventors of the present invention have found that by substituting one or more of the key amino acid residues, employing e.g. one of the above described methods to mutate the encoding nucleic acids, the herbicide tolerance or resistance could be remarkably increased as compared to the activity of the wild type PPO enzymes with SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313. Preferred substitutions of mutated PPO are those that increase the herbicide tolerance of the plant, but leave the biological activity of the oxidase activity substantially unaffected.

Accordingly, in another object of the present invention the key amino acid residues of a PPO enzyme comprising SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, is substituted by any other amino acid.

In one embodiment, the key amino acid residues of a PPO enzyme, a variant, derivative, orthologue, paralogue or homologue thereof, is substituted by a conserved amino acid as depicted in Table 1.

It will be understood by the person skilled in the art that amino acids located in a close proximity to the positions of amino acids mentioned below may also be substituted. Thus, in another embodiment the variant of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof comprises a mutated PPO, wherein an amino acid ±3, ±2 or ±1 amino acid positions from a key amino acid is substituted by any other amino acid.

Based on techniques well-known in the art, a highly characteristic sequence pattern can be developed, by means of which further of mutated PPO candidates with the desired activity may be searched.

Searching for further mutated PPO candidates by applying a suitable sequence pattern would also be encompassed by the present invention. It will be understood by a skilled reader that the present sequence pattern is not limited by the exact distances between two adjacent amino acid residues of said pattern. Each of the distances between two neighbours in the above patterns may, for example, vary independently of each other by up to ±10, ±5, ±3, ±2 or ±1 amino acid positions without substantially affecting the desired activity.

Furthermore, by applying the method of site directed mutagenesis, in particular saturation mutagenes (see e.g. Schenk et al., Biospektrum 03/2006, pages 277-279), the inventors of the present invention have identified and generated specific amino acid substitutions and combinations thereof, which—when introduced into a plant by transforming and expressing the respective mutated PPO encoding nucleic acid—confer increased herbicide resistance or tolerance to a PPO inhibiting herbicide to said plant.

Thus, in a particularly preferred embodiment, the variant or derivative of the mutated PPO refers to a polypeptide comprising SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, comprising a single amino acid substitution at positions depicted in the following Table 2a.

Table 2a: Single amino acid substitutions within SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313

| ID | Organism | Mut site 1 | Mut site 2 | Mut site 3 | Mute site 4 | Mut site 5 |
|---|---|---|---|---|---|---|
| 1 | 88809979[*Amaranthus tuberculatus*] | R128 | G210 | G211 | L397 | F420 |
| 2 | PPO[*Salinibacter_ruber*_M8] | R87 | A161 | G162 | L330 | F353 |
| 3 | PPO[*Rhodothermus_marinus* DSM4252] | R87 | A162 | G163 | L330 | F353 |
| 4 | PPO[*Salinibacter_ruber*_DSM13855] | R87 | A161 | G162 | L330 | F353 |
| 5 | PPO[*Rhodothermus_marinus_* SG05JP17-172] | R87 | A162 | G163 | L330 | F353 |
| 6 | PPO[*Halothio_bacillus_ neapolitanusc*_2] | R97 | A170 | G171 | L343 | F366 |
| 7 | YP_003547456PPO[*Coralio_ margarita_akajimensis*_DSM45221] | R88 | A163 | G164 | L323 | F346 |
| 8 | YP_863962PPO[*Magnetococcus_ marinus*_MC-1] | R94 | A167 | G168 | L338 | F361 |
| 9 | YP_001819575PPO[*Opitutus_ terrae*_PB90-1] | R103 | A178 | G179 | L345 | M368 |
| 10 | YP_006526861PPO[*Melioribacter_ roseus*_P3M-2] | R88 | A163 | G164 | L333 | F356 |
| 11 | XP_001760919[*Physcomitrella_ patens*] | R83 | G165 | S166 | L362 | F385 |
| 12 | XP_002509548_*amineoxidase* [Ricinuscommunis] | R99 | A181 | G182 | L372 | F395 |
| 13 | YP_572852PPO[*Chromohalobacter_ salexigens*_DSM3043] | R103 | A177 | G178 | L349 | F372 |
| 14 | YP_006766810PPO[*Leptospirillum_ ferriphilum*ML-04] | R92 | A167 | S168 | L335 | F358 |
| 15 | XP_002984571[*Selaginella_ moellendorffii*] | R97 | G175 | S176 | L377 | F400 |
| 16 | XP_002978633[*Selaginella_ moellendorffii*] | R97 | G175 | S176 | L377 | F400 |
| 17 | NP_196926PPO-likeprotein[*Arabidopsis_ thaliana*] | R101 | A182 | A183 | L371 | F394 |
| 18 | YP_004749312PPO(X)aerobic [*Acidithiobacillus_caldus*_SM-1] | R89 | A164 | G165 | L325 | F348 |
| 19 | XP_002873656_HEMG2_MEE61 [*Arabidopsis_lyratasubsplyrata*] | R103 | A186 | A187 | L375 | F398 |
| 20 | NP_001236376_PPOX[Glycine_ max] | R98 | A180 | A181 | L367 | F390 |
| 21 | YP_002568450PPO[*Chloroflexus_* spY-400-fl] | R91 | A166 | G167 | L335 | L358 |
| 22 | XP_003622202PPO[*Medicago_ truncatula*] | R98 | A180 | A181 | L367 | F390 |
| 23 | YP_002464647PPO[*Chloroflexus_ aggregans*_DSM9485] | R92 | A167 | G168 | L336 | L359 |
| 24 | XP_002263321_PPO_*mitochondrial* [*Vitis_vinifera*] | R100 | G182 | G183 | L373 | F396 |
| 25 | NP_001105004_PPOX(*mitochondrial*) 2[Zeamays] | R130 | A215 | G216 | L410 | F433 |
| 26 | NP_001190307_[*Arabidopsis_ thaliana*] | R101 | A152 | A153 | L341 | F364 |
| 27 | YP_003433215PPO[*Hydrogenobacter_ thermophilus*_TK-6] | R84 | A158 | G159 | L310 | Y333 |
| 28 | YP_004151624PPO[*Thermovibrio_ ammonificans*_HB-1] | R86 | A160 | G161 | L333 | M356 |
| 29 | YP_005845210PPO[*Ignavibacterium_ album*_JCM16511] | R88 | A163 | G164 | L332 | F355 |

-continued

| ID | Organism | Mut site 1 | Mut site 2 | Mut site 3 | Mute site 4 | Mut site 5 |
|---|---|---|---|---|---|---|
| 30 | XP_002446710_06g020950[*Sorghum_ bicolor*] | R130 | A215 | G216 | L410 | F433 |
| 31 | YP_004281001PPO[*Desulfurobacterium_ thermolithotrophum_* DSM11699] | R86 | A161 | G162 | L333 | M356 |
| 32 | YP_004784657PPO[*Acidithiobacillus_ ferrivorans_*ss3] | R87 | A162 | G163 | L323 | F346 |
| 33 | YP_003474039PPO[*Thermocrinis_ albus_*DSM14484] | — | A158 | G159 | L309 | Y332 |
| 34 | YP_002796374PPO[*Laribacter_ hongkongensis_*HLHK9] | R84 | A159 | G160 | A314 | F337 |
| 35 | YP_002219182PPO[*Acidithiobacillus_ ferrooxidans_*ATCC53993] | R87 | A162 | G163 | L323 | F346 |
| 36 | YP_003496573PPO[*Deferribacterde_ sulfuricans_*SSM1] | R92 | A167 | G168 | L330 | M353 |
| 37 | YP_001228933PPO[*Geobacteruraniireducens*Rf4]__ | R93 | A170 | G171 | L344 | M367 |
| 38 | YP_002248561 PPO[*Thermodesulfovibrio_ yellowstonii_*DSM11347] | R89 | A164 | G165 | L328 | M351 |
| 39 | NP_951074PPO[*Geobacter_ sulfurreducens_*PCA] | R93 | A168 | G169 | L342 | M365 |
| 40 | YP_006889062PPO[*Geobacter_ sulfurreducens_*KN400] | R93 | A168 | G169 | L342 | M365 |
| 41 | NP_214383PPO[Aquifex_aeolicus_VF5] | R86 | A159 | G160 | L309 | F332 |
| 42 | YP_006716472PPO[*Pelobacter_ carbinolicus_*DSM2380] | R92 | A167 | G168 | L340 | M363 |
| 43 | YP_006722497PPO[*Geobacter_ metallireducens_*GS-15] | R93 | A168 | G169 | L342 | M365 |
| 44 | YP_678185PPO[*Cytophagahutchinsonii_* ATCC33406] | R84 | A158 | G159 | A317 | F340 |
| 45 | YP_002539155PPO[*Geobacter_ daltonii_*FRC-32] | R93 | A170 | G171 | L344 | M367 |
| 46 | NP_906211PPO[*Porphyromonasgingivalis*W83]__ | R86 | A160 | G161 | L330 | F353 |
| 47 | YP_005367195PPO[*Corallococcus_ coralloides_*DSM2259] | R86 | A161 | G162 | L333 | L356 |
| 48 | YP_004050820PPO[*Calditerrivibrio_ nitroreducens_*DSM19672] | R92 | A166 | G167 | L328 | I351 |
| 49 | YP_004509986PPO[*Porphyromonas_ gingivalis_*TDC60] | R86 | A160 | G161 | L330 | F353 |
| 50 | YP_003951559PPO[*Stigmatella_ aurantiaca_*DW4_3-1] | R87 | A162 | G163 | L331 | L354 |
| 51 | YP_001928320PPO[*Porphyromonas_ gingivalis_*ATCC33277] | R86 | A160 | G161 | L330 | F353 |
| 52 | YP_005468670PPO[*Leptospirillum_ ferrooxidans_*C2-3] | R93 | A171 | S172 | L342 | F365 |
| 53 | YP_003390864PPO[*Spirosoma_ linguale_*DSM74] | R92 | A166 | G167 | A326 | F349 |
| 54 | YP_003207907_PPO[*Candidatus_ methylomirabilis_*oxyfera] | T101 | G184 | A185 | I353 | F376 |
| 55 | YP_899713PPO[*Pelobacter_ propionicus_*DSM2379] | R93 | A170 | G171 | L344 | M367 |
| 56 | 214383PPO[Aquifex_aeolicus_ VF5] | R86 | A159 | G160 | L309 | F332 |
| 57 | 003207907_PPOX[*Candidatus_ methylomirabilis_*oxyfera] | T101 | G184 | A185 | 1353 | F376 |
| 58 | SPTREMBLH5S9D0_9BACT_ PPO[BAL527661] | R88 | A161 | G162 | L330 | F353 |
| 59 | SPTREMBLB6APB6_9BACT_ PPO[EDZ391021] | R92 | A167 | S168 | L335 | F358 |
| 60 | SPTREMBU3SAIO_AMBAR_ Mitochondrial_PPO[AFJ041191]Flags: Fragment | R74 | G151 | G152 | L336 | F359 |
| 61 | SPTREMBLA7LIU6_AMAHP_ *Mitochondrial_*PPO[ABS721651] | R128 | G210 | G211 | L398 | F421 |
| 62 | SPTREMBLG5DW06_SILLA_ PPO[AEL987031]Flags:Fragment | R96 | A178 | A179 | L361 | F384 |
| 63 | SPTREMBLG5DW07_SILLA_ PPO[AEL987041] Flags: Fragment | R96 | A178 | A179 | L361 | F384 |
| 64 | SPTREMBLK4BDT2_SOLLC [Solyc03g00508021] | R95 | G175 | G176 | L366 | F389 |
| 65 | SPTREMBLC6HX77_9BACT_ PPO[EES527871] | R92 | A172 | S173 | L339 | F362 |
| 66 | SPTREMBLB4F9N9_MAIZE [ACF788321_GRMZM_2G364901_P04] | R130 | A215 | G216 | L410 | F433 |
| 67 | SPTREMBLI1PMI3_ORYGL[ECO: 0000313_ORGLA_04G01402001] | R95 | G180 | G181 | L375 | F398 |
| 68 | SPTREMBLK3Y6C6_SETIT [Si009767m] | R128 | A213 | G214 | L408 | F431 |

-continued

| ID | Organism | Mut site 1 | Mut site 2 | Mut site 3 | Mute site 4 | Mut site 5 |
|---|---|---|---|---|---|---|
| 69 | SPTREMBLI1IZ42_BRADI [BRADI5G141201] | R97 | A182 | G183 | L377 | F400 |
| 70 | SPTREMBLJ3LZ44_ORYBR [OB04G241901] | R139 | G224 | G225 | L419 | F442 |
| 71 | SPTREMBLB8LQQ3_PICSI [ABR179831] | R100 | G186 | A187 | L354 | F377 |
| 72 | SPTREMBLQ7X7T4_O RYSJ_ [CAE016612] | R95 | G179 | G180 | L374 | F397 |
| 73 | SPTREMBLQ8L152_PORGN_PPO [BAB930021] | R86 | A160 | G161 | L330 | F353 |
| 74 | ORYSJ_EEE612361 | R95 | G190 | G191 | L385 | F408 |
| 75 | PPO[Salinibacter_ruber_M8] | R87 | A161 | G162 | L330 | F353 |
| 76 | PPO[*Rhodothermus_marinus* DSM4252] | R87 | A162 | G163 | L330 | F353 |
| 77 | Tcastaneum_EST\|DT795976. orf ORF predicted by ESTScan and supported by blastx | E104 | K158 | S159 | R343 | L366 |
| 78 | Tcastaneum_EST\|DN649354. Orf ORF predicted by ESTScan and supported by blastx | K82 | K135 | N136 | V326 | W345 |
| 79 | *Mycosphaerella_graminicola*\|e stExt_fgenesh1_pm.C_chr_130138 | N98 | — | — | V387 | K415 |
| 80 | *Mycosphaerella_graminicola*\|f genesh1_pg.C_chr_4000196 | P257 | G347 | A348 | L652 | I705 |
| 81 | *Mycosphaerella_graminicola*\|e_ gw1.6.178.1 | R144 | A226 | G227 | L420 | M443 |
| 82 | Apisum_EST CN759425.orf ORF predicted by ESTScan and supported by blastx | R77 | G161 | G162 | — | L222 |
| 83 | Schizophyllum_commune\|e_ gw1.2.533.1 | K104 | A181 | A182 | L364 | M391 |
| 84 | gi_491060495_WP_004922129.1_ [*Acinetobacter*] | — | — | — | — | V106 |
| 85 | gi_491073786_WP_004935408.1_ [*Acinetobacter_soli*] | — | — | — | — | V106 |
| 86 | gi_640671255_WP_025096265.1_ [*Acinetobacter_soli*] | — | — | — | — | V106 |
| 87 | gi_491300310_WP_005158314.1_ [*Acinetobacter*_sp._NIPH_284] | — | — | — | — | V106 |
| 88 | gi_490943302_WP_004805133.1_ [*Acinetobacter*] | — | — | — | — | V106 |
| 89 | gi_490801335_WP_004663472.1_ [*Acinetobacter*_sp._NIPH_236] | — | — | — | — | V106 |
| 90 | gi_491463643_WP_005321413.1_ [*Acinetobacter*_sp._ANC_3880] | — | — | — | — | V106 |
| 91 | gi_491381361_WP_005239243.1_ [*Acinetobacter*] | — | — | — | — | V106 |
| 92 | gi_491292983_WP_005150999.1_ [*Acinetobacter*_sp._ANC_3929] | — | — | — | — | V106 |
| 93 | gi_490793063_WP_004655209.1_ [*Acinetobacter*] | — | — | — | — | V106 |
| 94 | gi_507093809_WP_016164505.1_ [*Acinetobacter*_sp._CIP_110321] | — | — | — | — | I106 |
| 95 | gi_490909009_WP_004770928.1_ [*Acinetobacter*_sp._NIPH_758] | — | — | — | — | V106 |
| 96 | gi_514351070_WP_016543182.1_ Protoporphyrinogen_IX_oxidase_ [*Acinetobacter_gyllenbergii*] | — | — | — | — | V106 |
| 97 | gi_491371149_WP_005229045.1_ [*Acinetobacter*] | — | — | — | — | V106 |
| 98 | gi_494745796_WP_007481204.1_ [*Acinetobacter*_sp._NBRC_100985] | — | — | — | — | V106 |
| 99 | gi_491426157_WP_005283952.1_ [*Acinetobacter*_sp._NIPH_3623] | — | — | — | — | V106 |
| 100 | gi_518214819_WP_019385027.1_ [*Acinetobacter*_venetianus] | — | — | — | — | V106 |
| 101 | gi_491233156_WP_005091388.1_ [*Acinetobacter*] | — | — | — | — | V106 |
| 102 | gi_490807961_WP_004670082.1_ [*Acinetobacter*] | — | — | — | — | V106 |
| 103 | gi_490832850_WP_004694935.1_ [*Acinetobacter_johnsonii*] | — | — | — | — | V106 |
| 104 | gi_491199143_WP_005057487.1_ [*Acinetobacter_beijerinckii*] | — | — | — | — | V106 |
| 105 | gi_517509805_WP_018680013.1_ [*Acinetobacter_tjernbergiae*] | — | — | — | — | V106 |

-continued

| ID | Organism | Mut site 1 | Mut site 2 | Mut site 3 | Mute site 4 | Mut site 5 |
|---|---|---|---|---|---|---|
| 106 | gi_490968207_WP_004830008.1_ [*Acinetobacter*] | — | — | — | — | V106 |
| 107 | gi_490775991_WP_004638180.1_ [*Acinetobacter_haemolyticus*] | — | — | — | — | V106 |
| 108 | gi_446262034_WP_000339889.1_ [*Acinetobacter_baumannii* | — | — | — | — | V106 |
| 109 | gi_740513810_WP_038343223.1_ [*Acinetobacter*_sp._A47] | — | — | — | — | V106 |
| 110 | gi_490783939_WP_004646107.1_ [*Acinetobacter*] | — | — | — | — | V106 |
| 111 | gi_491019396_WP_004881102.1_ [*Acinetobacter*] | — | — | — | — | V106 |
| 112 | gi_487977643_WP_002050435.1_ [*Acinetobacter_calcoaceticus*/ *baumannii*_complex] | — | — | — | — | V106 |
| 113 | gi_491223237_WP_005081535.1_ [*Acinetobacter_haemolyticus*] | — | — | — | — | V106 |
| 114 | gi_488052372_WP_002123769.1_ [*Acinetobacter_baumannii*] | — | — | — | — | V106 |
| 115 | gi_507096641_WP_016167285.1 [Bacteria] | — | — | — | — | V106 |
| 116 | gi_490868591_WP_004730607.1_ [*Acinetobacter_lwoffii*] | — | — | — | — | V106 |
| 117 | gi_727733814_WP_033853987.1_ [*Acinetobacter_baumannii*] | — | — | — | — | V106 |
| 118 | gi_491091059_WP_004952667.1_ [*Acinetobacter_junii*] | — | — | — | — | V106 |
| 119 | gi_491001037_WP_004862759.1_ [*Acinetobacter_gerneri*] | — | — | — | — | V106 |
| 120 | gi_507071235_WP_016142013.1_ [*Acinetobacter_calcoaceticus*/ *baumannii*_complex] | — | — | — | — | V106 |
| 121 | gi_490861624_WP_004723664.1_ [*Acinetobacter*] | — | — | — | — | V106 |
| 122 | gi_691147280_WP_032059889.1_ [*Acinetobacter_baumannii*] | — | — | — | — | V106 |
| 123 | gi_446262035_WP_000339890.1_ [*Acinetobacter_baumannii*] | — | — | — | — | V106 |
| 124 | gi_691132016_WP_032047106.1_ [*Acinetobacter_baumannii*] | — | — | — | — | V106 |
| 125 | gi_491198176_WP_005056522.1_ [*Acinetobacter_beijerinckii*] | — | — | — | — | V106 |
| 126 | gi_490853389_WP_004715441.1_ [*Acinetobacter_baumannii*] | — | — | — | — | V106 |
| 127 | gi_691152991_WP_032064531.1_ [*Acinetobacter_baumannii*] | — | — | — | — | V106 |
| 128 | gi_491153426_WP_005011820.1_ [*Acinetobacter_bouvetii*] | — | — | — | — | V106 |
| 129 | gi_690978247_WP_031952185.1_ [*Acinetobacter_baumannii*] | — | — | — | — | V106 |
| 130 | gi_488062334_WP_002133731.1_ [*Acinetobacter_baumannii*] | — | — | — | — | V106 |
| 131 | gi_490876399_WP_004738397.1_ [*Acinetobacter_baumannii*] | — | — | — | — | V106 |
| 132 | gi_490841261_WP_004703336.1_ [*Acinetobacter*] | — | — | — | — | V106 |
| 133 | gi_491246621_WP_005104820.1_ [*Acinetobacter*] | — | — | — | — | V106 |
| 134 | gi_488048894_WP_002120291.1_ [*Acinetobacter*] | — | — | — | — | V106 |
| 135 | gi_691000309_WP_031967803.1_ [*Acinetobacter_baumannii*] | — | — | — | — | V106 |
| 136 | gi_674997132_dbj_BAP38474.1_ AS4_35340_[*Acinetobacter_guillouiae*] | — | — | — | — | A106 |
| 137 | gi_507068277_WP_016139056.1_ [*Acinetobacter_calcoaceticus*] | — | — | — | — | A106 |
| 138 | gi_490932313_WP_004794166.1_ [*Acinetobacter*_sp._NIPH_817] | — | — | — | — | V106 |
| 139 | gi_491445334_WP_005303121.1_ [*Acinetobacter*_sp._NIPH_542] | — | — | — | — | V106 |
| 140 | gi_490405121_WP_004279237.1_ [*Acinetobacter*] | — | — | — | — | V106 |
| 141 | gi_518597712_WP_019767919.1_ [*Acinetobacter_pittii*] | — | — | — | — | V106 |
| 142 | gi_491132625_WP_004991052.1_ [*Acinetobacter*] | — | — | — | — | V106 |

-continued

| ID | Organism | Mut site 1 | Mut site 2 | Mut site 3 | Mute site 4 | Mut site 5 |
|---|---|---|---|---|---|---|
| 143 | gi_691007858_WP_031972487.1_ [*Acinetobacter_baumannii*] | — | — | — | — | V106 |
| 144 | gi_498011842_WP_010325998.1_ [*Acinetobacter_lwoffii*] | — | — | — | — | V106 |
| 145 | gi_507073740_WP_016144514.1_ [*Acinetobacter_calcoaceticus/ baumannii*_complex] | — | — | — | — | V106 |
| 146 | gi_446262033_WP_000339888.1_ [*Acinetobacter_baumannii*] | — | — | — | — | V106 |
| 147 | gi_740520658_WP_038348690.1_ [*Acinetobacter_baumannii*] | — | — | — | — | V106 |
| 148 | gi_490949350_WP_004811175.1_ [*Acinetobacter*] | — | — | — | — | V106 |
| 149 | gi_763233177_WP_044103433.1_ [*Acinetobacter_pittii*] | — | — | — | — | V106 |
| 150 | gi_491031623_WP_004893309.1_ [*Acinetobacter*] | — | — | — | — | V106 |
| 151 | gi_502963802_WP_013198778.1_ [*Acinetobacter_oleivorans*] | — | — | — | — | A106 |
| 152 | gi_757660258_WP_042898554.1_ [*Acinetobacter_oleivorans*] | — | — | — | — | V106 |
| 153 | gi_491393256_WP_005251118.1_ [*Acinetobacter*_sp._CIP_102136] | — | — | — | — | I106 |
| 154 | gi_737284983_WP_035268308.1_ [*Acinetobacter*_sp._Ver3] | — | — | — | — | M106 |
| 155 | gi_490779430_WP_004641616.1_ [*Acinetobacter_calcoaceticus*] | — | — | — | — | V106 |
| 156 | gi_491542560_WP_005400179.1_ [*Acinetobacter_johnsonii*] | — | — | — | — | V106 |
| 157 | gi_736573757_WP_034585295.1_ [*Acinetobacter*_sp._H R7] | — | — | — | — | V106 |
| 158 | gi_491190266_WP_005048623.1_ [*Acinetobacter_calcoaceticus*] | — | — | — | — | V106 |
| 159 | gi_806779784_g b_KKC42497.1_ [*Acinetobacter*_sp._V2] | — | — | — | — | A106 |
| 160 | gi_491314383_WP_005172361.1_ [*Acinetobacter*_sp._NIPH_713] | — | — | — | — | V106 |
| 161 | gi_490921415_WP_004783286.1_ [*Acinetobacter*] | — | — | — | — | V106 |
| 162 | gi_780011786_WP_045436702.1_ [*Acinetobacter_calcoaceticus*] | — | — | — | — | V106 |
| 163 | gi_489749291_WP_003653300.1_ [*Acinetobacter_calcoaceticus*] | — | — | — | — | V106 |
| 164 | gi_764631789_WP_044437332.1_ [*Acinetobacter_ursingii*] | — | — | — | — | V106 |
| 165 | gi_496875031_WP_009393745.1_ [*Acinetobacter*_sp._WC-141] | — | — | — | — | A106 |
| 166 | gi_491376400_WP_005234291.1_ [*Acinetobacter*_sp._NIPH_2171] | — | — | — | — | I106 |
| 167 | gi_491184319_WP_005042681.1_ [*Acinetobacter_calcoaceticus*] | — | — | — | — | V106 |
| 168 | gi _491116810_WP_004975 266.1_ [*Acinetobacter*] | — | — | — | — | V106 |
| 169 | gi_491237786_WP_005096009.1_ [*Acinetobacter_lwoffii*] | — | — | — | — | V106 |
| 170 | gi_491321890_WP_005179856.1_ [*Acinetobacter*] | — | — | — | — | V106 |
| 171 | gi_696292260_WP_032867909.1_ [*Acinetobacter_baumannii*] | — | — | — | — | V106 |
| 172 | gi_555507570_WP_023272706.1_ [*Acinetobacter_nectaris*] | — | — | — | — | V106 |
| 173 | gi_491160499_WP_005018886.1 | — | — | — | — | V106 |
| 174 | gi_490814452_WP_004676559.1_ [*Acinetobacter*] | — | — | — | — | V106 |
| 175 | gi_741483336_gb_KHW96815.1_ [*Acinetobacter_baumannii*] | — | — | — | — | V98 |
| 176 | gi_490785848_WP_004648010.1_ [*Acinetobacter_bohemicus*] | — | — | — | — | V106 |
| 177 | gi_491052309_WP_004913960.1_ [*Acinetobacter_junii*] | — | — | — | — | V106 |
| 178 | gi_507094777_WP_016165450.1_ [*Acinetobacter_tandoii*] | — | — | — | — | V106 |
| 179 | gi_497801016_WP_010115200.1_ [*Acinetobacter*_sp._P8-3-8] | — | — | — | — | V106 |
| 180 | gi_514969048_WP_016657344.1_ [*Acinetobacter_rudis*] | — | — | — | — | V104 |

-continued

| ID | Organism | Mut site 1 | Mut site 2 | Mut site 3 | Mute site 4 | Mut site 5 |
|---|---|---|---|---|---|---|
| 181 | gi_491040303_WP_004901972.1_ [*Acinetobacter_brisouii*] | — | — | — | — | V106 |
| 182 | gi_490888651_WP_004750604.1_ [*Acinetobacter*_sp._ANC_3789] | — | — | — | — | V106 |
| 183 | gi_746597285_WP_039623499.1_ [*Acinetobacter_harbinensis*] | — | — | — | — | F106 |
| 184 | hemG [*Escherichia coli*] | — | — | — | — | I142 |
| 185 | gi_446776703_WP_000853959.1 [*Escherichia coli*] | — | — | — | — | I142 |
| 186 | gi_585368532_WP_024250110.1_ PPO_dehydro_[*Enterobacteriaceae*] | — | — | — | — | I142 |
| 187 | gi_446776716_WP_000853972.1_ PPO_[*Shigellaflexneri*] | — | — | — | — | I142 |
| 188 | gi_803576760_WP_046082718.1_ PPO_[*Escherichiafergusonii*] | — | — | — | — | I142 |
| 189 | gi_446776730_WP_000853986.1_ PPOdehydro_[*Shigellaflexneri*] | — | — | — | — | I142 |
| 190 | gi_446776711_WP_000853967.1_ PPO_[*Escherichiaalbertii*] | — | — | — | — | I142 |
| 191 | gi_507088140_WP_016158875.1_ PPOdehydro_[*Escherichia*] | — | — | — | — | I142 |
| 192 | gi_745765271_WP_039062592.1_ PPO_[*Shigellaflexneri*] | — | — | — | — | I142 |
| 193 | gi_446776709_WP_000853965.1_ PPO_[*Escherichia* sp.TW15838] | — | — | — | — | I142 |
| 194 | gi_446776715_WP_000853971.1_ PPO_[*Shigellasonnei*] | — | — | — | — | I142 |
| 195 | gi_446776710_WP_000853966.1_ PPO_[*Escherichiaalbertii*] | — | — | — | — | I142 |
| 196 | gi_446776697_WP_000853953.1_ PPO_[*Escherichiaalbertii*] | — | — | — | — | I142 |
| 197 | gi_446776718_WP_000853974.1_ PPO_[*Enterobacteriaceae*] | — | — | — | — | I142 |
| 198 | gi_446776720_WP_000853976.1_ PPO_[*Shigella*] | — | — | — | — | I142 |
| 199 | gi_446776717_WP_000853973.1_ PPO_[*Shigellaflexneri*] | — | — | — | — | I142 |
| 200 | gi_554685272_WP_023185166.1_ PPO_[*Salmonellaenterica*] | — | — | — | — | I142 |
| 201 | gi_308927673_gb_EFP73142.1_ PPO_[*Shigelladysenteriae*1617] | — | — | — | — | 1122 |
| 202 | gi_754936070_WP_042292697.1_ PPO_[*Citrobactersedlakii*] | — | — | — | — | I142 |
| 203 | gi_446776725_WP_000853981.1_ PPO_[*Salmonellaenterica*] | — | — | — | — | I142 |
| 204 | gi_721474711_gb_KGY18299.1_ PPO_[*Citrobacterkoseri*] | — | — | — | — | I142 |
| 205 | gi_446776724_WP_000853980.1_ PPO_[*Salmonellaenterica*] | — | — | — | — | I142 |
| 206 | gi_740611784_WP_038397304.1_ PPO_[*Salmonellaenterica*] | — | — | — | — | I142 |
| 207 | gi_526249624_*Poxidaseoxygen*-independent_HemG_ [*Salmonellabongori*] | — | — | — | — | I142 |
| 208 | gi_157081684_gb_ABV11362.1_ [*Citrobacterkoseri*ATCCBAA-895] | — | — | — | — | I142 |
| 209 | gi_685237852_WP_031606088.1_ PPO_[*Salmonellaenterica*] | — | — | — | — | I142 |
| 210 | gi_502672073_WP_012907885.1_ PPO_[*Citrobacterrodentium*] | — | — | — | — | I142 |
| 211 | gi_446776722_WP_000853978.1_ PPO_[*Salmonellabongori*] | — | — | — | — | I142 |
| 212 | gi_673531409_emb_CDZ82112.1_ PPO_[*Citrobacterkoseri*] | — | — | — | — | I142 |
| 213 | gi_446776726_WP_000853982.1_ PPO_[*Salmonellaenterica*] | — | — | — | — | I142 |
| 214 | gi_554246566_gb_ESG83296.1_ PPO_[*Salmonellaenterica*ATCC9263] | — | — | — | — | I142 |
| 215 | gi_555286377_WP_023261035.1_ PPO_dehydro_[*Salmonellaenterica*] | — | — | — | — | I142 |
| 216 | gi_446776696_WP_00085395 2.1_PPOdehydro_[*Salmonellaenterica*] | — | — | — | — | I142 |
| 217 | gi_446776729_WP_000853985.1_ PPO_[*Salmonellaenterica*] | — | — | — | — | I142 |
| 218 | gi_521135495_WP_020437566.1_ PPO_[*Salmonellaenterica*] | — | — | — | — | I142 |

-continued

| ID | Organism | Mut site 1 | Mut site 2 | Mut site 3 | Mute site 4 | Mut site 5 |
|---|---|---|---|---|---|---|
| 219 | gi_565623524_WP_023891183.1_ PPO_[*Salmonellaenterica*] | — | — | — | — | I142 |
| 220 | gi_446776727_WP_000853983.1_ PPOdehydro_[*Salmonellaenterica*] | — | — | — | — | I142 |
| 221 | gi_446776692_WP_000853948.1_ PPO_[*Salmonellaenterica*] | — | — | — | — | I142 |
| 222 | gi_446776723_WP_000853979.1_ PPO_[*Salmonellaenterica*] | — | — | — | — | I142 |
| 223 | gi_446776728_WP_000853984.1_ PPOdehydro_[*Salmonellaenterica*] | — | — | — | — | I142 |
| 224 | gi_446776731_WP_000853987.1_ PPO_[*Salmonellaenterica*] | — | — | — | — | I142 |
| 225 | gi_740607825_WP_038393357.1_ PPO_[*Salmonellabongori*] | — | — | — | — | I142 |
| 226 | gi_555219141_WP_023212016.1_ PPO_[*Salmonellaenterica*] | — | — | — | — | I142 |
| 227 | gi_487372158_WP_001645833.1_ oxidaseHemG_[*Salmonellaenterica*] | — | — | — | — | I142 |
| 228 | gi_555265933_WP_023247423.1_ PPO_[*Salmonellaenterica*] | — | — | — | — | I142 |
| 229 | gi_754970294_WP_042326191.1_ PPO_[*Citrobacterfarmeri*] | — | — | — | — | I142 |
| 230 | gi_763106372_WP_043986528.1_ PPO_[*Salmonellaenterica*] | — | — | — | — | I142 |
| 231 | gi_555241082_WP_023225751.1_ PPO_[*Salmonellaenterica*] | — | — | — | — | I142 |
| 232 | gi_677962583_gb_KFU71595.1_ PPO_[*Salmonella_enterica*CFSAN000181] | — | — | — | — | I142 |
| 233 | gi_780043845_WP_045449176.1_ PPO_[*Citrobacter*sp.S-77] | — | — | — | — | I142 |
| 234 | gi_757780254_WP_042998838.1_ PPO_[*Citrobacter*] | — | — | — | — | I142 |
| 235 | gi_391303361_gb_EIQ61198.1_ PPO_dehydro_[*Shigellaflexneri*_235-66] | — | — | — | — | I142 |
| 236 | gi_489925542_WP_003828882.1_ PPO_[*Citrobacterfreundii*] | — | — | — | — | I142 |
| 237 | gi_489107987_WP_003017846.1_ PPO_[*Enterobacteriaceae*] | — | — | — | — | I142 |
| 238 | gi_353612405_gb_EHC64786.1_ oxidase_HemG_[*Salmonellaenterica*] | — | — | — | — | I142 |
| 239 | gi_489937947_WP_003841254.1_ PPO_[*Citrobacterfreundii*] | — | — | — | — | I142 |
| 240 | gi_749607088_WP_040230104.1_ PPO_[*Citrobacter*sp.CIP55.13] | — | — | — | — | I142 |
| 241 | gi_696370724_WP_032945724.1_ PPO_[*Citrobacterfreundii*] | — | — | — | — | I142 |
| 242 | gi_721586509_gb_KGZ29783.1_ PPO_[*Citrobacterfreundii*] | — | — | — | — | I142 |
| 243 | gi_757801814_WP_043019011.1_ PPO_[*Citrobacterfreundii*] | — | — | — | — | I142 |
| 244 | gi_507084406_WP_016155152.1_ PPOdehydro_[*Citrobacter*sp.KTE151] | — | — | — | — | I142 |
| 245 | gi_817120192_WP_046493069.1_ PPO_[*Citrobacter_amalonaticus*] | — | — | — | — | I142 |
| 246 | gi_496062597_WP_008787104.1_ PPO_[*Citrobacter*sp.30_2] | — | — | — | — | I142 |
| 247 | gi_507087120_WP_016157860.1_ PPOdehydro_[*Citrobacter*sp.KTE32] | — | — | — | — | I142 |
| 248 | gi_740849175_WP_038634428.1_ PPO_[*Citrobacterfreundii*] | — | — | — | — | I142 |
| 249 | gi_446981838_WP_001059094.1_ PPO_[*Salmonellaenterica*] | — | — | — | — | I148 |
| 250 | gi_493736907_WP_006686103.1_ PPO_[*Citrobacteryoungae*] | — | — | — | — | I142 |
| 251 | gi_685253248_WP_031613095.1_ PPO_partial_[*Salmonellaenterica*] | — | — | — | — | I132 |
| 252 | gi_772672412_WP_045285595.1_ PPO_[*Enterobacter*_sp_35699] | — | — | — | — | I142 |
| 253 | gi_640460605_WP_024908008.1_ PPO_[*Enterobacterasburiae*] | — | — | — | — | I142 |
| 254 | gi_695718339_WP_032646055.1_ PPO_[*Enterobacter*] | — | — | — | — | I142 |
| 255 | gi_779819602_WP_045336933.1_ PPO_[*Enterobacterasburiae*] | — | — | — | — | I142 |
| 256 | gi_647320203_WP_025757509.1_ PPO_[*Enterobactercloacae*] | — | — | — | — | I142 |

-continued

| ID | Organism | Mut site 1 | Mut site 2 | Mut site 3 | Mute site 4 | Mut site 5 |
|---|---|---|---|---|---|---|
| 257 | gi_798942147_WP_045909212.1_ PPO_[*Enterobactercloacae*] | — | — | — | — | I142 |
| 258 | gi_504646581_WP_014833683.1_ PPO_[*Enterobactercloacae*] | — | — | — | — | I142 |
| 259 | gi_504698508_WP_014885610.1_ PPO_[*Enterobacter*] | — | — | — | — | I142 |
| 260 | gi_495776931_WP_008501510.1_ PPO_[*Enterobacter*] | — | — | — | — | I142 |
| 261 | gi_556497388_WP_023345075.1_ PPO_dehydro_[*Enterobacter*] | — | — | — | — | I142 |
| 262 | g i_5 5 6474668_WP_02 3 326273.1_ PPO_dehydro_[*Enterobacter*spMGH34] | — | — | — | — | I142 |
| 263 | gi_503838244_WP_014072238.1_ PPO_[*Enterobacter_asburiae*] | — | — | — | — | I142 |
| 264 | gi_502864250_WP_013099226.1_ PPO_[*Enterobacter*] | — | — | — | — | I142 |
| 265 | gi_779900435_WP_045372184.1_ PPO_[*Enterobacterasburiae*] | — | — | — | — | I142 |
| 266 | gi_779803830_WP_045330210.1_ PPO_[*Enterobacterasburiae*] | — | — | — | — | I142 |
| 267 | gi_772702242_WP_045294988.1_ PPO_[*Enterobacter*sp.42324] | — | — | — | — | I142 |
| 268 | gi_556485438_WP_023333780.1_ PPO_dehydro[*Enterobacter*_ spMGH_24] | — | — | — | — | I142 |
| 269 | gi_654547061_WP_028014767.1_ PPO_[*Enterobacter*] | — | — | — | — | I142 |
| 270 | gi_805302683_WP_046092447.1_ PPO_[*Enterobactercloacae*] | — | — | — | — | I142 |
| 271 | gi_527036124_WP_020882866.1_ PPO_[*Enterobacter_cloacae*] | — | — | — | — | I142 |
| 272 | gi_695706440_WP_032641484.1_ PPO_[*Enterobacter*_sp_EGD-HP1] | — | — | — | — | I142 |
| 273 | gi_556479963_WP_023331543.1_ PPO_[*Enterobacter_cloacae*] | — | — | — | — | I142 |
| 274 | gi_654550469_WP_028018162.1_ PPO_[*Enterobactercloacae*] | — | — | — | — | I142 |
| 275 | CoPPO III *Escherichia coli* K-12 substr. MG1655 | S85 | G118 | A119 | R237 | Q256 |
| 276 | CoPPO III aerobic [E. coli 3-020-07_ S1_C3] | S85 | G118 | A119 | R237 | Q256 |
| zn | CoPPO III [*Shigella boydii*] | S85 | G118 | A119 | R237 | Q256 |
| 278 | CoPPO III, aerobic [*Citrobacter youngae* 29220] | S85 | G118 | A119 | R237 | Q256 |
| 279 | CoPPO III [*Citrobacter rodentium*] | S85 | G118 | A119 | R237 | Q256 |
| 280 | CoPPO III [*Salmonella enterica*] | S85 | G118 | A119 | R237 | Q256 |
| 281 | CoPPO III [*Citrobacter freundii*] | S85 | G118 | A119 | R237 | Q256 |
| 282 | CoPPO III [*Rhizobium* sp. KAs 5-22] | S85 | G118 | A119 | R237 | Q256 |
| 283 | CoPPO III [*Vibrio parahaemolyticus*] | S85 | D118 | A119 | R237 | Q256 |
| 284 | CoPPO III [*Enterobacter lignolyticus*] | S85 | G118 | A119 | R237 | Q256 |
| 285 | CoPPO III [*Enterobacteriaceae bacterium* FGI 57] | S85 | G118 | A119 | R237 | Q256 |
| 286 | CoPPO III [*Enterobacter aerogenes*] | S85 | G118 | A119 | R237 | Q256 |
| 287 | CoPPO III [*Kluyvera ascorbata*] | S85 | G118 | A119 | R237 | Q256 |
| 288 | CoPPO III [*Trabulsiella guamensis*] | S85 | G118 | A119 | R237 | Q256 |
| 289 | CoPPO III [*Raoultella planticola*] | S85 | G118 | A119 | R237 | Q256 |
| 290 | CoPPO III [*Kosakonia radicincitans*] | S85 | G118 | A119 | R237 | Q256 |
| 291 | CoPPO III [*Enterococcus gallinarum* EGD-AAK12] | S85 | G118 | A119 | R237 | Q256 |
| 292 | CoPPO III [*gamma proteobacterium* WG36] | S88 | G121 | E122 | R240 | Q259 |
| 293 | CoPPO III [*Shewanella loihica*] | S86 | G119 | A120 | R238 | Q257 |
| 294 | CoPPO III [*Oceanimonas smirnovii*] | S88 | G121 | A122 | R240 | Q259 |
| 295 | CoPPO III [*Chromobacterium piscinae*] | R87 | G120 | E121 | R239 | Q258 |

-continued

| ID | Organism | Mut site 1 | Mut site 2 | Mut site 3 | Mute site 4 | Mut site 5 |
|---|---|---|---|---|---|---|
| 296 | CoPPO III [*Pseudogulbenkiania ferrooxidans*] | R87 | G120 | E121 | R239 | Q258 |
| 297 | CoPPO III [*Chromobacterium violaceum*] | R87 | G120 | E121 | R239 | Q258 |
| 298 | CoPPO III [*Aeromonas hydrophila*] | R87 | G120 | E121 | R239 | Q258 |
| 299 | CoPPO III [*Glaciecola* sp. HTCC2999] | R92 | G125 | E126 | R244 | Q263 |
| 300 | CoPPO III [*Alteromonas macleodii*] | N91 | G124 | E125 | R243 | Q262 |
| 301 | CoPPO III [*Gilvimarinus chinensis*] | S87 | G120 | A121 | R239 | Q258 |
| 312 | hemJ [*Acinetobacter baylyi*] | | | | | |
| 313 | hemY [*Escherichia coli*] | | | | | |

In a further particularly preferred embodiment, the variant or derivative of the mutated PPO refers to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, comprising a single amino acid substitutions at the positions depicted in the following Table 2b.

It should be noted that Mutated site 1 of Table 2a) corresponds to Pos 1 of Table 2b); Mutated site 2 of Table 2a) corresponds to Pos 15 of Table 2b); Mutated site 3 of Table 2a) corresponds to Pos 16 of Table 2b); Mutated site 4 of Table 2a) corresponds to Pos 38 of Table 2b); Mutated site 5 of Table 2a) corresponds to Pos 42 of Table 2b).

TABLE 2b-1

| ID | Pos 1 | Pos 2 | Pos 3 | Pos 4 | Pos 5 | Pos 6 | Pos 7 | Pos 8 | Pos 9 | Pos 10 |
|---|---|---|---|---|---|---|---|---|---|---|
| 1 | R128 | Y129 | A131 | S149 | I151 | A154 | P164 | K169 | E182 | S183 |
| 2 | R87 | Y88 | V90 | T108 | L110 | T113 | P123 | — | E133 | S134 |
| 3 | R87 | F88 | V90 | T108 | L110 | P113 | P123 | — | E134 | S135 |
| 4 | R87 | Y88 | V90 | T108 | L110 | T113 | P123 | — | E133 | S134 |
| 5 | R87 | F88 | V90 | T108 | L110 | P113 | P123 | — | E134 | S135 |
| 6 | R97 | F98 | A100 | S118 | L120 | M123 | A133 | — | E142 | T143 |
| 7 | R88 | Y89 | V91 | T109 | L111 | I114 | P124 | — | Q135 | S136 |
| 8 | R94 | F95 | M97 | T115 | L117 | L120 | P130 | — | E139 | S140 |
| 9 | R103 | Y104 | V106 | S124 | L126 | P129 | L139 | — | V150 | S151 |
| 10 | R88 | Y89 | L91 | T109 | L111 | S114 | P124 | — | Q135 | S136 |
| 11 | R83 | Y84 | V86 | T104 | L106 | A109 | P119 | R124 | E137 | N138 |
| 12 | R99 | Y100 | V102 | S120 | 1122 | A125 | P135 | K140 | E153 | S154 |
| 13 | R103 | Y104 | A106 | N124 | L126 | L129 | P139 | — | E149 | S150 |
| 14 | R92 | Y93 | V95 | T113 | L115 | W118 | — | — | E139 | T140 |
| 15 | R97 | Y98 | V100 | T118 | L120 | A123 | P133 | — | E147 | S148 |
| 16 | R97 | Y98 | V100 | T118 | L120 | A123 | P133 | — | E147 | S148 |
| 17 | R101 | Y102 | V104 | S122 | V124 | T127 | P137 | K142 | E154 | S155 |
| 18 | R89 | F90 | L92 | S109 | L111 | L114 | P124 | — | E136 | S137 |
| 19 | R103 | Y104 | V106 | S124 | V126 | T129 | P139 | K144 | E158 | S159 |
| 20 | R98 | Y99 | V101 | S119 | L121 | A124 | P134 | R139 | E152 | S153 |
| 21 | R91 | F92 | L94 | T112 | L114 | W117 | P127 | — | E138 | S139 |
| 22 | R98 | Y99 | V101 | S119 | L121 | A124 | P134 | R139 | E152 | S153 |
| 23 | R92 | Y93 | L95 | T113 | L115 | W118 | P128 | — | E139 | S140 |
| 24 | R100 | Y101 | V103 | S121 | I123 | A126 | P136 | K141 | E154 | S155 |
| 25 | R130 | Y131 | V133 | S151 | V153 | T156 | P166 | K171 | E187 | S188 |
| 26 | R101 | Y102 | V104 | — | — | — | — | — | E124 | 8125 |
| 27 | R84 | Y85 | Y87 | S105 | F107 | L110 | P120 | — | E130 | S131 |
| 28 | R86 | F87 | Y89 | S107 | L109 | W112 | L122 | — | E132 | T133 |
| 29 | R88 | Y89 | L91 | T109 | L111 | A114 | P124 | — | Q135 | S136 |
| 30 | R130 | Y131 | V133 | S151 | V153 | T156 | P166 | K171 | E187 | S188 |
| 31 | R86 | F87 | Y89 | S107 | L109 | W112 | F122 | — | E133 | S134 |
| 32 | R87 | Y88 | L90 | G107 | L109 | W112 | P122 | — | E134 | S135 |
| 33 | — | Y85 | Y87 | S105 | L107 | L110 | P120 | — | E130 | T131 |
| 34 | R84 | F85 | L87 | G105 | Q107 | A110 | P120 | — | E131 | T132 |

TABLE 2b-1-continued

| | | | | | | | | | | |
|---|---|---|---|---|---|---|---|---|---|---|
| 35 | R87 | Y88 | L90 | G107 | L109 | I112 | P122 | — | E134 | S135 |
| 36 | R92 | Y93 | M95 | S113 | L115 | F118 | L128 | — | E139 | T140 |
| 37 | R93 | F94 | Y96 | S114 | L116 | W119 | P131 | — | E142 | T143 |
| 38 | R89 | Y90 | L92 | T110 | L112 | F115 | Y125 | — | E136 | T137 |
| 39 | R93 | F94 | Y96 | S114 | L116 | W119 | P129 | — | E140 | T141 |
| 40 | R93 | F94 | Y96 | S114 | L116 | W119 | P129 | — | E140 | T141 |
| 41 | R86 | Y87 | Y89 | T107 | L109 | L112 | I122 | — | I131 | S132 |
| 42 | R92 | F93 | F95 | S113 | L115 | W118 | L128 | — | E139 | T140 |
| 43 | R93 | F94 | Y96 | S114 | L116 | W119 | P129 | — | E140 | T141 |
| 44 | R84 | F85 | Y87 | G105 | F107 | A110 | L120 | — | E130 | T131 |
| 45 | R93 | F94 | Y96 | 5114 | L116 | W119 | P131 | — | E142 | T143 |
| 46 | R86 | L87 | W89 | T107 | L109 | L112 | P122 | — | E132 | T133 |
| 47 | R86 | Y87 | F89 | S107 | I109 | L112 | L122 | — | E133 | S134 |
| 48 | R92 | Y93 | M95 | T113 | L115 | F118 | Y128 | — | E138 | S139 |
| 49 | R86 | L87 | W89 | T107 | L109 | L112 | P122 | — | E132 | T133 |
| 50 | R87 | 588 | Y90 | S108 | L110 | L113 | L123 | — | E134 | S135 |
| 51 | R86 | L87 | W89 | T107 | L109 | L112 | P122 | — | E132 | T133 |
| 52 | R93 | Y94 | W96 | T114 | L116 | L119 | F129 | — | E143 | T141 |
| 53 | R92 | F93 | F95 | G113 | F115 | W118 | R128 | — | E138 | T139 |
| 54 | T101 | F102 | V104 | S130 | L132 | W135 | L145 | — | E156 | S157 |
| 55 | R93 | F94 | Y96 | S114 | L116 | W119 | P131 | — | E142 | S143 |
| 56 | R86 | Y87 | Y89 | T107 | L109 | L112 | I122 | — | I131 | S132 |
| 57 | T101 | F102 | V104 | S130 | L132 | W135 | L145 | — | E156 | S157 |
| 58 | R88 | Y89 | V91 | S109 | L111 | W114 | P124 | — | E133 | S134 |
| 59 | R92 | Y93 | V95 | T113 | L115 | W118 | — | — | E139 | T140 |
| 60 | R74 | Y75 | V77 | S95 | F97 | T100 | P110 | — | E123 | S124 |
| 61 | R128 | Y129 | A131 | S149 | I151 | A154 | P164 | K169 | E182 | S183 |
| 62 | R96 | Y97 | V99 | S117 | F119 | P122 | P132 | R137 | E150 | S151 |
| 63 | R96 | Y97 | V99 | S117 | F119 | A122 | P132 | R137 | E150 | S151 |
| 64 | R95 | Y96 | A98 | S116 | F118 | T121 | P131 | N136 | E147 | S148 |
| 65 | R92 | F93 | L95 | T113 | I115 | L118 | P128 | — | E144 | T145 |
| 66 | R130 | Y131 | V133 | S151 | V153 | T156 | P166 | K171 | E187 | S188 |
| 67 | R95 | Y96 | V98 | S116 | V118 | T121 | P131 | K136 | E152 | S153 |
| 68 | R128 | Y129 | V131 | S149 | V151 | T154 | P164 | K169 | E185 | S186 |
| 69 | R97 | Y98 | V100 | S118 | V120 | T123 | P133 | K138 | E154 | S155 |
| 70 | R139 | Y140 | V142 | S160 | V162 | T165 | P175 | K180 | E196 | S197 |
| 71 | R100 | Y101 | V103 | S121 | T123 | A126 | P136 | H141 | E158 | S159 |
| 72 | R95 | Y96 | V98 | S116 | V118 | T121 | P131 | K136 | E152 | S153 |
| 73 | R86 | L87 | W89 | T107 | L109 | L112 | P122 | — | E132 | T133 |
| 74 | R95 | Y96 | V98 | S116 | V118 | T121 | P131 | K136 | E152 | S153 |
| 75 | R87 | Y88 | V90 | T108 | L110 | T113 | P123 | A128 | — | S134 |
| 76 | R87 | F88 | V90 | T108 | L110 | P113 | P123 | A128 | E134 | S135 |
| 77 | E104 | I105 | Y107 | H115 | F117 | E170 | E128 | N133 | K139 | S140 |
| 78 | K82 | M83 | Y85 | N93 | L95 | D98 | S105 | I110 | L116 | S117 |
| 79 | N98 | I99 | F101 | E118 | 1120 | W123 | — | S139 | L145 | S146 |
| 80 | P257 | F258 | E260 | A283 | P285 | T288 | G301 | N306 | L319 | R320 |
| 81 | R144 | F145 | Y147 | E172 | V174 | T177 | F187 | D192 | E198 | S199 |
| 82 | R77 | Y78 | F80 | K105 | W107 | Y110 | N120 | L125 | E133 | S134 |
| 83 | K104 | Y105 | H107 | S127 | L129 | C132 | M142 | R147 | E153 | S154 |
| 84 | — | — | — | — | I16 | V19 | — | L32 | H45 | R46 |
| 85 | — | — | — | — | I16 | V19 | — | L32 | H45 | R46 |
| 86 | — | — | — | — | I16 | V19 | — | L32 | H45 | R46 |
| 87 | — | — | — | — | I16 | V19 | — | L32 | H45 | Q46 |
| 88 | — | — | — | — | I16 | V19 | — | L32 | H45 | Q46 |
| 89 | — | — | — | — | I16 | V19 | — | L32 | H45 | Q46 |
| 90 | — | — | — | — | I16 | V19 | — | L32 | H45 | Q46 |
| 91 | — | — | — | — | I16 | V19 | — | L32 | H45 | Q46 |
| 92 | — | — | — | — | I16 | V19 | — | L32 | H45 | Q46 |
| 93 | — | — | — | — | I16 | V19 | — | L32 | H45 | Q46 |
| 94 | — | — | — | — | I16 | V19 | — | L32 | H45 | Q46 |
| 95 | — | — | — | — | I16 | V19 | — | L32 | H45 | Q46 |
| 96 | — | — | — | — | I16 | V19 | — | L32 | H45 | Q46 |
| 97 | — | — | — | — | I16 | V19 | — | L32 | H45 | Q46 |
| 98 | — | — | — | — | I16 | V19 | — | L32 | H45 | Q46 |
| 99 | — | — | — | — | I16 | V19 | — | L32 | H45 | Q46 |
| 100 | — | — | — | — | I16 | V19 | — | L32 | H45 | Q46 |
| 101 | — | — | — | — | I16 | V19 | — | L32 | H45 | Q46 |
| 102 | — | — | — | — | I16 | V19 | — | L32 | H45 | Q46 |
| 103 | — | — | — | — | I16 | V19 | — | L32 | H45 | Q46 |
| 104 | — | — | — | — | I16 | V19 | — | L32 | H45 | Q46 |
| 105 | — | — | — | — | I16 | V19 | — | L32 | H45 | Q46 |
| 106 | — | — | — | — | I16 | V19 | — | L32 | H45 | Q46 |
| 107 | — | — | — | — | I16 | V19 | — | L32 | H45 | Q46 |
| 108 | — | — | — | — | I16 | V19 | — | L32 | H45 | Q46 |
| 109 | — | — | — | — | I16 | V19 | — | L32 | H45 | Q46 |
| 110 | — | — | — | — | I16 | V19 | — | L32 | H45 | Q46 |
| 111 | — | — | — | — | I16 | V19 | — | L32 | H45 | Q46 |
| 112 | — | — | — | — | I16 | V19 | — | L32 | H45 | Q46 |
| 113 | — | — | — | — | I16 | V19 | — | L32 | H45 | Q46 |
| 114 | — | — | — | — | I16 | V19 | — | L32 | H45 | Q46 |

TABLE 2b-1-continued

| | | | | | | | | | | |
|---|---|---|---|---|---|---|---|---|---|---|
| 115 | — | — | — | — | I16 | V19 | — | L32 | H45 | Q46 |
| 116 | — | — | — | — | I16 | V19 | — | L32 | H45 | Q46 |
| 117 | — | — | — | — | I16 | V19 | — | L32 | H45 | Q46 |
| 118 | — | — | — | — | I16 | V19 | — | L32 | H45 | Q46 |
| 119 | — | — | — | — | I16 | V19 | — | L32 | H45 | Q46 |
| 120 | — | — | — | — | I16 | V19 | — | L32 | H45 | Q46 |
| 121 | — | — | — | — | I16 | V19 | — | L32 | H45 | Q46 |
| 122 | — | — | — | — | I16 | V19 | — | L32 | H45 | H46 |
| 123 | — | — | — | — | I16 | V19 | — | L32 | H45 | Q46 |
| 124 | — | — | — | — | I16 | V19 | — | L32 | H45 | Q46 |
| 125 | — | — | — | — | I16 | V19 | — | L32 | H45 | Q46 |
| 126 | — | — | — | — | I16 | V19 | — | L32 | H45 | Q46 |
| 127 | — | — | — | — | I16 | V19 | — | L32 | H45 | Q46 |
| 128 | — | — | — | — | I16 | V19 | — | L32 | H45 | Q46 |
| 129 | — | — | — | — | I16 | V19 | — | L32 | H45 | Q46 |
| 130 | — | — | — | — | I16 | V19 | — | L32 | H45 | Q46 |
| 131 | — | — | — | — | I16 | V19 | — | L32 | H45 | Q46 |
| 132 | — | — | — | — | I16 | V19 | — | L32 | H45 | Q46 |
| 133 | — | — | — | — | I16 | V19 | — | L32 | H45 | Q46 |
| 134 | — | — | — | — | I16 | V19 | — | L32 | H45 | Q46 |
| 135 | — | — | — | — | I16 | V19 | — | L32 | H45 | Q46 |
| 136 | — | — | — | — | I16 | V19 | — | L32 | H45 | Q46 |
| 137 | — | — | — | — | I16 | V19 | — | L32 | H45 | Q46 |
| 138 | — | — | — | — | I16 | V19 | — | L32 | H45 | Q46 |
| 139 | — | — | — | — | I16 | V19 | — | L32 | H45 | Q46 |
| 140 | — | — | — | — | I16 | V19 | — | L32 | H45 | Q46 |
| 141 | — | — | — | — | I16 | V19 | — | L32 | H45 | Q46 |
| 142 | — | — | — | — | I16 | V19 | — | L32 | H45 | Q46 |
| 143 | — | — | — | — | I16 | V19 | — | L32 | H45 | Q46 |
| 144 | — | — | — | — | I16 | V19 | — | L32 | H45 | Q46 |
| 145 | — | — | — | — | I16 | V19 | — | L32 | H45 | Q46 |
| 146 | — | — | — | — | I16 | V19 | — | L32 | H45 | Q46 |
| 147 | — | — | — | — | I16 | V19 | — | L32 | H45 | Q46 |
| 148 | — | — | — | — | I16 | V19 | — | L32 | H45 | Q46 |
| 149 | — | — | — | — | I16 | V19 | — | L32 | H45 | Q46 |
| 150 | — | — | — | — | I16 | V19 | — | L32 | H45 | Q46 |
| 151 | — | — | — | — | I16 | V19 | — | L32 | H45 | Q46 |
| 152 | — | — | — | — | I16 | V19 | — | L32 | H45 | Q46 |
| 153 | — | — | — | — | I16 | V19 | — | L32 | H45 | Q46 |
| 154 | — | — | — | — | I16 | V19 | — | L32 | H45 | Q46 |
| 155 | — | — | — | — | I16 | V19 | — | L32 | H45 | Q46 |
| 156 | — | — | — | — | I16 | V19 | — | L32 | H45 | Q46 |
| 157 | — | — | — | — | I16 | V19 | — | L32 | H45 | E46 |
| 158 | — | — | — | — | I16 | V19 | — | L32 | H45 | Q46 |
| 159 | — | — | — | — | I16 | V19 | — | L32 | H45 | Q46 |
| 160 | — | — | — | — | I16 | V19 | — | L32 | H45 | Q46 |
| 161 | — | — | — | — | I16 | V19 | — | L32 | H45 | Q46 |
| 162 | — | — | — | — | I16 | V19 | — | L32 | H45 | Q46 |
| 163 | — | — | — | — | I16 | V19 | — | L32 | H45 | Q46 |
| 164 | — | — | — | — | I16 | V19 | — | L32 | H45 | Q46 |
| 165 | — | — | — | — | I16 | V19 | — | L32 | H45 | Q46 |
| 166 | — | — | — | — | I16 | V19 | — | L32 | H45 | Q46 |
| 167 | — | — | — | — | I16 | V19 | — | L32 | H45 | Q46 |
| 168 | — | — | — | — | I16 | V19 | — | L32 | H45 | Q46 |
| 169 | — | — | — | — | I16 | V19 | — | L32 | H45 | A46 |
| 170 | — | — | — | — | I16 | V19 | — | L32 | H45 | Q46 |
| 171 | — | — | — | — | I16 | V19 | — | L32 | H45 | Q46 |
| 172 | — | — | — | — | I16 | V19 | — | L32 | Y45 | E46 |
| 173 | — | — | — | — | I16 | V19 | — | L32 | H45 | Q46 |
| 174 | — | — | — | — | I16 | V19 | — | L32 | H45 | Q46 |
| 175 | — | — | — | — | I8 | V11 | — | L24 | H37 | Q38 |
| 176 | — | — | — | — | I16 | V19 | — | L32 | H45 | Q46 |
| 177 | — | — | — | — | I16 | V19 | — | L32 | H45 | Q46 |
| 178 | — | — | — | — | I16 | V19 | — | L32 | H45 | Q46 |
| 179 | — | — | — | — | I16 | V19 | — | L32 | H45 | Q46 |
| 180 | — | — | — | — | I14 | V17 | — | L30 | H43 | Q44 |
| 181 | — | — | — | — | I16 | V19 | — | L32 | H45 | Q46 |
| 182 | — | — | — | — | I16 | V19 | — | L32 | H45 | Q46 |
| 183 | — | — | — | — | I16 | I19 | — | L32 | H45 | Q46 |
| 184 | — | — | — | — | — | — | — | — | — | — |
| 185 | — | — | — | — | — | — | — | — | — | — |
| 186 | — | — | — | — | — | — | — | — | — | — |
| 187 | — | — | — | — | — | — | — | — | — | — |
| 188 | — | — | — | — | — | — | — | — | — | — |
| 189 | — | — | — | — | — | — | — | — | — | — |
| 190 | — | — | — | — | — | — | — | — | — | — |
| 191 | — | — | — | — | — | — | — | — | — | — |
| 192 | — | — | — | — | — | — | — | — | — | — |
| 193 | — | — | — | — | — | — | — | — | — | — |
| 194 | — | — | — | — | — | — | — | — | — | — |

TABLE 2b-1-continued

| | | | | | | | | | | |
|---|---|---|---|---|---|---|---|---|---|---|
| 195 | — | — | — | — | — | — | — | — | — | — |
| 196 | — | — | — | — | — | — | — | — | — | — |
| 197 | — | — | — | — | — | — | — | — | — | — |
| 198 | — | — | — | — | — | — | — | — | — | — |
| 199 | — | — | — | — | — | — | — | — | — | — |
| 200 | — | — | — | — | — | — | — | — | — | — |
| 201 | — | — | — | — | — | — | — | — | — | — |
| 202 | — | — | — | — | — | — | — | — | — | — |
| 203 | — | — | — | — | — | — | — | — | — | — |
| 204 | — | — | — | — | — | — | — | — | — | — |
| 205 | — | — | — | — | — | — | — | — | — | — |
| 206 | — | — | — | — | — | — | — | — | — | — |
| 207 | — | — | — | — | — | — | — | — | — | — |
| 208 | — | — | — | — | — | — | — | — | — | — |
| 209 | — | — | — | — | — | — | — | — | — | — |
| 210 | — | — | — | — | — | — | — | — | — | — |
| 211 | — | — | — | — | — | — | — | — | — | — |
| 212 | — | — | — | — | — | — | — | — | — | — |
| 213 | — | — | — | — | — | — | — | — | — | — |
| 214 | — | — | — | — | — | — | — | — | — | — |
| 215 | — | — | — | — | — | — | — | — | — | — |
| 216 | — | — | — | — | — | — | — | — | — | — |
| 217 | — | — | — | — | — | — | — | — | — | — |
| 218 | — | — | — | — | — | — | — | — | — | — |
| 219 | — | — | — | — | — | — | — | — | — | — |
| 220 | — | — | — | — | — | — | — | — | — | — |
| 221 | — | — | — | — | — | — | — | — | — | — |
| 222 | — | — | — | — | — | — | — | — | — | — |
| 223 | — | — | — | — | — | — | — | — | — | — |
| 224 | — | — | — | — | — | — | — | — | — | — |
| 225 | — | — | — | — | — | — | — | — | — | — |
| 226 | — | — | — | — | — | — | — | — | — | — |
| 227 | — | — | — | — | — | — | — | — | — | — |
| 228 | — | — | — | — | — | — | — | — | — | — |
| 229 | — | — | — | — | — | — | — | — | — | — |
| 230 | — | — | — | — | — | — | — | — | — | — |
| 231 | — | — | — | — | — | — | — | — | — | — |
| 232 | — | — | — | — | — | — | — | — | — | — |
| 233 | — | — | — | — | — | — | — | — | — | — |
| 234 | — | — | — | — | — | — | — | — | — | — |
| 235 | — | — | — | — | — | — | — | — | — | — |
| 236 | — | — | — | — | — | — | — | — | — | — |
| 237 | — | — | — | — | — | — | — | — | — | — |
| 238 | — | — | — | — | — | — | — | — | — | — |
| 239 | — | — | — | — | — | — | — | — | — | — |
| 240 | — | — | — | — | — | — | — | — | — | — |
| 241 | — | — | — | — | — | — | — | — | — | — |
| 242 | — | — | — | — | — | — | — | — | — | — |
| 243 | — | — | — | — | — | — | — | — | — | — |
| 244 | — | — | — | — | — | — | — | — | — | — |
| 245 | — | — | — | — | — | — | — | — | — | — |
| 246 | — | — | — | — | — | — | — | — | — | — |
| 247 | — | — | — | — | — | — | — | — | — | — |
| 248 | — | — | — | — | — | — | — | — | — | — |
| 249 | — | — | — | — | — | — | — | — | — | — |
| 250 | — | — | — | — | — | — | — | — | — | — |
| 251 | — | — | — | — | — | — | — | — | — | — |
| 252 | — | — | — | — | — | — | — | — | — | — |
| 253 | — | — | — | — | — | — | — | — | — | — |
| 254 | — | — | — | — | — | — | — | — | — | — |
| 255 | — | — | — | — | — | — | — | — | — | — |
| 256 | — | — | — | — | — | — | — | — | — | — |
| 257 | — | — | — | — | — | — | — | — | — | — |
| 258 | — | — | — | — | — | — | — | — | — | — |
| 259 | — | — | — | — | — | — | — | — | — | — |
| 260 | — | — | — | — | — | — | — | — | — | — |
| 261 | — | — | — | — | — | — | — | — | — | — |
| 262 | — | — | — | — | — | — | — | — | — | — |
| 263 | — | — | — | — | — | — | — | — | — | — |
| 264 | — | — | — | — | — | — | — | — | — | — |
| 265 | — | — | — | — | — | — | — | — | — | — |
| 266 | — | — | — | — | — | — | — | — | — | — |
| 267 | — | — | — | — | — | — | — | — | — | — |
| 268 | — | — | — | — | — | — | — | — | — | — |
| 269 | — | — | — | — | — | — | — | — | — | — |
| 270 | — | — | — | — | — | — | — | — | — | — |
| 271 | — | — | — | — | — | — | — | — | — | — |
| 272 | — | — | — | — | — | — | — | — | — | — |
| 273 | — | — | — | — | — | — | — | — | — | — |
| 274 | — | — | — | — | — | — | — | — | — | — |

TABLE 2b-1-continued

| | | | | | | | | | | |
|---|---|---|---|---|---|---|---|---|---|---|
| 275 | S85 | F86 | A88 | — | — | — | P100 | S105 | — | — |
| 276 | S85 | F86 | A88 | — | — | — | P100 | S105 | — | — |
| 277 | S85 | F86 | A88 | — | — | — | P100 | S105 | — | — |
| 278 | S85 | F86 | A88 | — | — | — | P100 | S105 | — | — |
| 279 | S85 | F86 | A88 | — | — | — | P100 | S105 | — | — |
| 280 | S85 | F86 | A88 | — | — | — | P100 | S105 | — | — |
| 281 | S85 | F86 | A88 | — | — | — | P100 | S105 | — | — |
| 282 | S85 | F86 | A88 | — | — | — | P100 | S105 | — | — |
| 283 | S85 | F86 | A88 | — | — | — | P100 | S105 | — | — |
| 284 | S85 | F86 | A88 | — | — | — | P100 | S105 | — | — |
| 285 | S85 | F86 | A88 | — | — | — | P100 | S105 | — | — |
| 286 | S85 | F86 | A88 | — | — | — | P100 | S105 | — | — |
| 287 | S85 | F86 | A88 | — | — | — | P100 | S105 | — | — |
| 288 | S85 | F86 | A88 | — | — | — | P100 | S105 | — | — |
| 289 | S85 | F86 | A88 | — | — | — | P100 | S105 | — | — |
| 290 | S85 | F86 | A88 | — | — | — | P100 | S105 | — | — |
| 291 | S85 | F86 | A88 | — | — | — | P100 | S105 | — | — |
| 292 | S88 | F89 | A91 | — | — | — | P103 | S108 | — | — |
| 293 | S86 | F87 | A89 | — | — | — | P101 | T106 | — | — |
| 294 | S88 | F89 | A91 | — | — | — | P103 | S108 | — | — |
| 295 | R87 | F88 | A90 | — | — | — | P102 | S107 | — | — |
| 296 | R87 | F88 | A90 | — | — | — | P102 | S107 | — | — |
| 297 | R87 | F88 | A90 | — | — | — | P102 | S107 | — | — |
| 298 | R87 | F88 | A90 | — | — | — | P102 | S107 | — | — |
| 299 | R92 | F93 | A95 | — | — | — | P107 | S112 | — | — |
| 300 | N91 | F92 | A94 | — | — | — | P106 | S111 | — | — |
| 301 | S87 | F88 | A90 | — | — | — | P102 | S107 | — | — |

| ID | Pos 11 | Pos 12 | Pos 13 | Pos 14 | Pos 15 | Pos 16 | Pos 17 | Pos 18 | Pos 19 | Pos 20 |
|---|---|---|---|---|---|---|---|---|---|---|
| 1 | E189 | F196 | D202 | C209 | G210 | G211 | L216 | M218 | H219 | H220 |
| 2 | E140 | V147 | A153 | F160 | A161 | G162 | L167 | V169 | Q170 | H171 |
| 3 | R141 | V148 | E154 | F161 | A162 | G163 | L168 | V170 | R171 | Y172 |
| 4 | E140 | V147 | A153 | F160 | A161 | G162 | L167 | V169 | Q170 | H171 |
| 5 | R141 | V148 | E154 | F161 | A162 | G163 | L168 | V170 | R171 | Y172 |
| 6 | R149 | F156 | D162 | Y169 | A170 | G171 | L176 | V178 | Q179 | A180 |
| 7 | T142 | L149 | N155 | Y162 | A163 | G164 | L169 | L171 | R172 | Y173 |
| 8 | I146 | F153 | E159 | Y166 | A167 | G168 | L173 | V175 | R176 | A177 |
| 9 | E157 | F164 | N170 | Y177 | A178 | G179 | L184 | A186 | R187 | Q188 |
| 10 | R142 | F149 | D155 | F162 | A163 | G164 | L169 | V171 | K172 | S173 |
| 11 | T144 | V151 | D157 | S164 | G165 | 5166 | V171 | I173 | R174 | H175 |
| 12 | Q160 | V167 | D173 | S180 | A181 | G182 | L187 | V189 | G190 | H191 |
| 13 | V156 | V163 | D169 | Y176 | A177 | G178 | L183 | A185 | Q186 | A187 |
| 14 | R146 | A153 | D159 | Y166 | A167 | 5168 | L173 | V175 | E176 | A177 |
| 15 | E154 | I161 | D167 | S174 | G175 | 5176 | I181 | I183 | R184 | H185 |
| 16 | E154 | I161 | D167 | S174 | G175 | 5176 | I181 | I183 | R184 | H185 |
| 17 | Q161 | V168 | D174 | S181 | A182 | A183 | L188 | M190 | K191 | H192 |
| 18 | R143 | A150 | D156 | F163 | A164 | G165 | L170 | V172 | T173 | A174 |
| 19 | Q165 | V172 | D178 | S185 | A186 | A187 | L192 | M194 | K195 | H196 |
| 20 | E159 | V166 | D172 | S179 | A180 | A181 | L186 | M188 | R189 | H190 |
| 21 | T145 | A152 | D158 | Y165 | A166 | G167 | L172 | T174 | A175 | A176 |
| 22 | E159 | V166 | D172 | S179 | A180 | A181 | L186 | I188 | R189 | H190 |
| 23 | S146 | A153 | D159 | Y166 | A167 | G168 | L173 | A175 | A176 | A177 |
| 24 | Q161 | V168 | D174 | S181 | G182 | G183 | L188 | M190 | H191 | H192 |
| 25 | E194 | V201 | D207 | S214 | A215 | G216 | L221 | I223 | R224 | H225 |
| 26 | Q131 | V138 | D144 | S151 | A152 | A153 | L158 | M160 | K161 | H162 |
| 27 | R137 | F144 | A150 | Y157 | A158 | G159 | L164 | V166 | K167 | Y168 |
| 28 | R139 | A146 | D152 | F159 | A160 | G161 | M166 | L168 | K169 | A170 |
| 29 | R142 | F149 | N155 | Y162 | A163 | G164 | L169 | V171 | K172 | S173 |
| 30 | E194 | V201 | D207 | S214 | A215 | G216 | L221 | I223 | C224 | H225 |
| 31 | K140 | A147 | D153 | F160 | A161 | G162 | L167 | L169 | K170 | A171 |
| 32 | R141 | A148 | D154 | F161 | A162 | G163 | L168 | V170 | Q171 | A172 |
| 33 | R137 | F144 | T150 | Y157 | A158 | G159 | L164 | I166 | K167 | Y168 |
| 34 | R138 | F145 | S151 | F158 | A159 | G160 | L165 | A167 | G168 | L169 |
| 35 | R141 | A148 | D154 | F161 | A162 | G163 | L168 | V170 | Q171 | A172 |
| 36 | Y146 | A153 | 5159 | F166 | A167 | G168 | L173 | L175 | K176 | S177 |
| 37 | R149 | A156 | A162 | F169 | A170 | G171 | M176 | L178 | V179 | S180 |
| 38 | S143 | F150 | D156 | Y163 | A164 | G165 | M170 | M172 | K173 | S174 |
| 39 | R147 | A154 | A160 | F167 | A168 | G169 | M174 | L176 | R177 | S178 |
| 40 | R147 | A154 | A160 | F167 | A168 | G169 | M174 | L176 | R177 | S178 |
| 41 | R138 | F145 | A151 | Y158 | A159 | G160 | L165 | L167 | K168 | H169 |
| 42 | R146 | A153 | G159 | F166 | A167 | G168 | M173 | L175 | R176 | S177 |
| 43 | R147 | A154 | S160 | F167 | A168 | G169 | M174 | L176 | R177 | S178 |
| 44 | A137 | F144 | D150 | Y157 | A158 | G159 | L164 | I166 | E167 | E168 |
| 45 | R149 | A156 | A162 | F169 | A170 | G171 | M176 | L178 | Q179 | S180 |
| 46 | R139 | F146 | D152 | Y159 | A160 | G161 | L166 | T168 | R169 | F170 |
| 47 | R140 | A147 | D153 | Y160 | A161 | G162 | L167 | A169 | E170 | A171 |
| 48 | R145 | A152 | S158 | F165 | A166 | G167 | M172 | L174 | R175 | S176 |
| 49 | R139 | F146 | D152 | Y159 | A160 | G161 | L166 | T168 | R169 | F170 |
| 50 | R141 | A148 | D154 | Y161 | A162 | G163 | L168 | A170 | E171 | A172 |

TABLE 2b-1-continued

| | | | | | | | | | | |
|---|---|---|---|---|---|---|---|---|---|---|
| 51 | R139 | F146 | D152 | Y159 | A160 | G161 | L166 | T168 | R169 | F170 |
| 52 | R150 | F157 | D163 | Y170 | A171 | 8172 | L177 | L179 | N180 | S181 |
| 53 | R145 | I152 | G158 | Y165 | A166 | G167 | L172 | V174 | S175 | E176 |
| 54 | R163 | F170 | Q176 | Y183 | G184 | A185 | L190 | L192 | R193 | A194 |
| 55 | R149 | A156 | S162 | F169 | A170 | G171 | M176 | L178 | V179 | S180 |
| 56 | R138 | F145 | A151 | Y158 | A159 | G160 | L165 | L167 | K168 | H169 |
| 57 | R163 | F170 | Q176 | Y183 | G184 | A185 | L190 | L192 | R193 | A194 |
| 58 | R140 | F147 | N153 | Y160 | A161 | G162 | L167 | V169 | R170 | F171 |
| 59 | R146 | A153 | D159 | Y166 | A167 | S168 | L173 | V175 | E176 | A177 |
| 60 | Q130 | V137 | D143 | S150 | G151 | G152 | L157 | M159 | R160 | H161 |
| 61 | E189 | F196 | D202 | C209 | G210 | G211 | L216 | V218 | H219 | H220 |
| 62 | G157 | F164 | D170 | S177 | A178 | A179 | I184 | M186 | R187 | H188 |
| 63 | G157 | F164 | D170 | S177 | A178 | A179 | I184 | M186 | R187 | H188 |
| 64 | Q154 | V161 | D167 | C174 | G175 | G176 | L181 | M183 | H184 | L185 |
| 65 | R151 | F158 | D164 | Y171 | A172 | S173 | L178 | M180 | A181 | D182 |
| 66 | E194 | V201 | D207 | S214 | A215 | G216 | L221 | I223 | R224 | H225 |
| 67 | E159 | V166 | D172 | S179 | G180 | G181 | L186 | I188 | R189 | H190 |
| 68 | E192 | V199 | D205 | S212 | A213 | G214 | L219 | I221 | R222 | H223 |
| 69 | E161 | V168 | D174 | S181 | A182 | G183 | L188 | I190 | R191 | H192 |
| 70 | E203 | V210 | D216 | S223 | G224 | G225 | L230 | I232 | R233 | H234 |
| 71 | R165 | V172 | D178 | A185 | G186 | A187 | L192 | I194 | R195 | H196 |
| 72 | C158 | V165 | D171 | S178 | G179 | G180 | L185 | I187 | R188 | H189 |
| 73 | R139 | F146 | D152 | Y159 | A160 | G161 | L166 | T168 | R169 | F170 |
| 74 | C169 | V176 | D182 | S189 | G190 | G191 | L196 | I198 | R199 | H200 |
| 75 | E140 | V147 | A153 | F160 | A161 | G162 | L167 | V169 | Q170 | H171 |
| 76 | R141 | V148 | E154 | F161 | A162 | G163 | L168 | V170 | R171 | Y172 |
| 77 | M146 | L153 | — | Y157 | K158 | S159 | L164 | L171 | H172 | F173 |
| 78 | L123 | I130 | — | Y134 | K135 | N136 | F141 | L148 | T149 | F150 |
| 79 | L152 | L159 | S165 | — | — | — | L170 | A172 | L173 | H174 |
| 80 | I326 | F333 | R339 | Y346 | G347 | A348 | I353 | T360 | Q361 | R362 |
| 81 | S205 | M212 | S218 | Y225 | A226 | G227 | L232 | A234 | K235 | S236 |
| 82 | C140 | F147 | S153 | C160 | G161 | G162 | M167 | V169 | K170 | F171 |
| 83 | C160 | F167 | S173 | F180 | A181 | A182 | L187 | V189 | R190 | A191 |
| 84 | E52 | I59 | — | — | — | — | — | — | — | — |
| 85 | E52 | I59 | — | — | — | — | — | — | — | — |
| 86 | E52 | I59 | — | — | — | — | — | — | — | — |
| 87 | E52 | I59 | — | — | — | — | — | — | — | — |
| 88 | E52 | I59 | — | — | — | — | — | — | — | — |
| 89 | E52 | I59 | — | — | — | — | — | — | — | — |
| 90 | E52 | I59 | — | — | — | — | — | — | — | — |
| 91 | E52 | I59 | — | — | — | — | — | — | — | — |
| 92 | E52 | I59 | — | — | — | — | — | — | — | — |
| 93 | E52 | I59 | — | — | — | — | — | — | — | — |
| 94 | E52 | I59 | — | — | — | — | — | — | — | — |
| 95 | E52 | I59 | — | — | — | — | — | — | — | — |
| 96 | E52 | I59 | — | — | — | — | — | — | — | — |
| 97 | E52 | I59 | — | — | — | — | — | — | — | — |
| 98 | E52 | I59 | — | — | — | — | — | — | — | — |
| 99 | E52 | I59 | — | — | — | — | — | — | — | — |
| 100 | E52 | I59 | — | — | — | — | — | — | — | — |
| 101 | E52 | I59 | — | — | — | — | — | — | — | — |
| 102 | E52 | I59 | — | — | — | — | — | — | — | — |
| 103 | E52 | I59 | — | — | — | — | — | — | — | — |
| 104 | E52 | I59 | — | — | — | — | — | — | — | — |
| 105 | E52 | I59 | — | — | — | — | — | — | — | — |
| 106 | E52 | I59 | — | — | — | — | — | — | — | — |
| 107 | E52 | I59 | — | — | — | — | — | — | — | — |
| 108 | E52 | I59 | — | — | — | — | — | — | — | — |
| 109 | E52 | I59 | — | — | — | — | — | — | — | — |
| 110 | E52 | I59 | — | — | — | — | — | — | — | — |
| 111 | E52 | I59 | — | — | — | — | — | — | — | — |
| 112 | E52 | I59 | — | — | — | — | — | — | — | — |
| 113 | E52 | I59 | — | — | — | — | — | — | — | — |
| 114 | E52 | I59 | — | — | — | — | — | — | — | — |
| 115 | E52 | I59 | — | — | — | — | — | — | — | — |
| 116 | E52 | I59 | — | — | — | — | — | — | — | — |
| 117 | E52 | I59 | — | — | — | — | — | — | — | — |
| 118 | E52 | I59 | — | — | — | — | — | — | — | — |
| 119 | E52 | I59 | — | — | — | — | — | — | — | — |
| 120 | E52 | I59 | — | — | — | — | — | — | — | — |
| 121 | E52 | I59 | — | — | — | — | — | — | — | — |
| 122 | E52 | I59 | — | — | — | — | — | — | — | — |
| 123 | E52 | I59 | — | — | — | — | — | — | — | — |
| 124 | E52 | I59 | — | — | — | — | — | — | — | — |
| 125 | E52 | I59 | — | — | — | — | — | — | — | — |
| 126 | E52 | I59 | — | — | — | — | — | — | — | — |
| 127 | E52 | I59 | — | — | — | — | — | — | — | — |
| 128 | E52 | I59 | — | — | — | — | — | — | — | — |
| 129 | E52 | I59 | — | — | — | — | — | — | — | — |
| 130 | E52 | I59 | — | — | — | — | — | — | — | — |

TABLE 2b-1-continued

| | | | | | | | | | | |
|---|---|---|---|---|---|---|---|---|---|---|
| 131 | E52 | I59 | — | — | — | — | — | — | — | — |
| 132 | E52 | I59 | — | — | — | — | — | — | — | — |
| 133 | E52 | I59 | — | — | — | — | — | — | — | — |
| 134 | E52 | I59 | — | — | — | — | — | — | — | — |
| 135 | E52 | I59 | — | — | — | — | — | — | — | — |
| 136 | E52 | I59 | — | — | — | — | — | — | — | — |
| 137 | E52 | I59 | — | — | — | — | — | — | — | — |
| 138 | E52 | I59 | — | — | — | — | — | — | — | — |
| 139 | E52 | I59 | — | — | — | — | — | — | — | — |
| 140 | E52 | I59 | — | — | — | — | — | — | — | — |
| 141 | E52 | I59 | — | — | — | — | — | — | — | — |
| 142 | E52 | I59 | — | — | — | — | — | — | — | — |
| 143 | E52 | I59 | — | — | — | — | — | — | — | — |
| 144 | E52 | I59 | — | — | — | — | — | — | — | — |
| 145 | E52 | I59 | — | — | — | — | — | — | — | — |
| 146 | E52 | I59 | — | — | — | — | — | — | — | — |
| 147 | E52 | I59 | — | — | — | — | — | — | — | — |
| 148 | E52 | I59 | — | — | — | — | — | — | — | — |
| 149 | E52 | I59 | — | — | — | — | — | — | — | — |
| 150 | E52 | I59 | — | — | — | — | — | — | — | — |
| 151 | E52 | I59 | — | — | — | — | — | — | — | — |
| 152 | E52 | I59 | — | — | — | — | — | — | — | — |
| 153 | E52 | I59 | — | — | — | — | — | — | — | — |
| 154 | E52 | I59 | — | — | — | — | — | — | — | — |
| 155 | E52 | I59 | — | — | — | — | — | — | — | — |
| 156 | E52 | I59 | — | — | — | — | — | — | — | — |
| 157 | E52 | I59 | — | — | — | — | — | — | — | — |
| 158 | E52 | I59 | — | — | — | — | — | — | — | — |
| 159 | E52 | I59 | — | — | — | — | — | — | — | — |
| 160 | E52 | I59 | — | — | — | — | — | — | — | — |
| 161 | E52 | I59 | — | — | — | — | — | — | — | — |
| 162 | E52 | I59 | — | — | — | — | — | — | — | — |
| 163 | E52 | I59 | — | — | — | — | — | — | — | — |
| 164 | E52 | I59 | — | — | — | — | — | — | — | — |
| 165 | E52 | I59 | — | — | — | — | — | — | — | — |
| 166 | E52 | I59 | — | — | — | — | — | — | — | — |
| 167 | E52 | I59 | — | — | — | — | — | — | — | — |
| 168 | E52 | I59 | — | — | — | — | — | — | — | — |
| 169 | E52 | I59 | — | — | — | — | — | — | — | — |
| 170 | E52 | I59 | — | — | — | — | — | — | — | — |
| 171 | E52 | I59 | — | — | — | — | — | — | — | — |
| 172 | E52 | I59 | — | — | — | — | — | — | — | — |
| 173 | E52 | I59 | — | — | — | — | — | — | — | — |
| 174 | E52 | I59 | — | — | — | — | — | — | — | — |
| 175 | E44 | I51 | — | — | — | — | — | — | — | — |
| 176 | E52 | I59 | — | — | — | — | — | — | — | — |
| 177 | E52 | I59 | — | — | — | — | — | — | — | — |
| 178 | E52 | I59 | — | — | — | — | — | — | — | — |
| 179 | E52 | I59 | — | — | — | — | — | — | — | — |
| 180 | E50 | I57 | — | — | — | — | — | — | — | — |
| 181 | E52 | I59 | — | — | — | — | — | — | — | — |
| 182 | E52 | I59 | — | — | — | — | — | — | — | — |
| 183 | E52 | I59 | — | — | — | — | — | — | — | — |
| 184 | — | — | — | — | — | — | A35 | V37 | H38 | R39 |
| 185 | — | — | — | — | — | — | A35 | V37 | H38 | R39 |
| 186 | — | — | — | — | — | — | T35 | V37 | H38 | R39 |
| 187 | — | — | — | — | — | — | A35 | V37 | H38 | R39 |
| 188 | — | — | — | — | — | — | A35 | V37 | H38 | R39 |
| 189 | — | — | — | — | — | — | A35 | V37 | H38 | R39 |
| 190 | — | — | — | — | — | — | A35 | V37 | H38 | R39 |
| 191 | — | — | — | — | — | — | A35 | V37 | H38 | R39 |
| 192 | — | — | — | — | — | — | A35 | V37 | H38 | R39 |
| 193 | — | — | — | — | — | — | A35 | V37 | H38 | R39 |
| 194 | — | — | — | — | — | — | A35 | V37 | H38 | R39 |
| 195 | — | — | — | — | — | — | A35 | V37 | H38 | R39 |
| 196 | — | — | — | — | — | — | A35 | V37 | H38 | R39 |
| 197 | — | — | — | — | — | — | A35 | V37 | H38 | R39 |
| 198 | — | — | — | — | — | — | A35 | V37 | H38 | R39 |
| 199 | — | — | — | — | — | — | A35 | V37 | H38 | R39 |
| 200 | — | — | — | — | — | — | V35 | L37 | H38 | R39 |
| 201 | — | — | — | — | — | — | A15 | V17 | H18 | R19 |
| 202 | — | — | — | — | — | — | V35 | L37 | H38 | R39 |
| 203 | — | — | — | — | — | — | V35 | L37 | H38 | R39 |
| 204 | — | — | — | — | — | — | 135 | L37 | H38 | R39 |
| 205 | — | — | — | — | — | — | V35 | L37 | H38 | R39 |
| 206 | — | — | — | — | — | — | V35 | L37 | H38 | R39 |
| 207 | — | — | — | — | — | — | V35 | L37 | H38 | R39 |
| 208 | — | — | — | — | — | — | 135 | L37 | H38 | R39 |
| 209 | — | — | — | — | — | — | V35 | L37 | H38 | R39 |
| 210 | — | — | — | — | — | — | F35 | L37 | H38 | R39 |

TABLE 2b-1-continued

| | | | | | | | | | | |
|---|---|---|---|---|---|---|---|---|---|---|
| 211 | — | — | — | — | — | — | V35 | L37 | H38 | R39 |
| 212 | — | — | — | — | — | — | 135 | L37 | H38 | R39 |
| 213 | — | — | — | — | — | — | V35 | L37 | H38 | R39 |
| 214 | — | — | — | — | — | — | V35 | L37 | H38 | R39 |
| 215 | — | — | — | — | — | — | V35 | L37 | H38 | R39 |
| 216 | — | — | — | — | — | — | V35 | L37 | H38 | R39 |
| 217 | — | — | — | — | — | — | V35 | L37 | H38 | R39 |
| 218 | — | — | — | — | — | — | V35 | L37 | H38 | R39 |
| 219 | — | — | — | — | — | — | V35 | L37 | H38 | R39 |
| 220 | — | — | — | — | — | — | V35 | L37 | H38 | R39 |
| 221 | — | — | — | — | — | — | V35 | L37 | H38 | R39 |
| 222 | — | — | — | — | — | — | V35 | L37 | H38 | R39 |
| 223 | — | — | — | — | — | — | V35 | L37 | H38 | R39 |
| 224 | — | — | — | — | — | — | V35 | L37 | H38 | R39 |
| 225 | — | — | — | — | — | — | V35 | L37 | H38 | R39 |
| 226 | — | — | — | — | — | — | V35 | L37 | H38 | R39 |
| 227 | — | — | — | — | — | — | V35 | L37 | H38 | R39 |
| 228 | — | — | — | — | — | — | V35 | L37 | H38 | R39 |
| 229 | — | — | — | — | — | — | V35 | L37 | H38 | R39 |
| 230 | — | — | — | — | — | — | V35 | L37 | H38 | R39 |
| 231 | — | — | — | — | — | — | V35 | L37 | H38 | R39 |
| 232 | — | — | — | — | — | — | V35 | L37 | H38 | R39 |
| 233 | — | — | — | — | — | — | V35 | L37 | H38 | R39 |
| 234 | — | — | — | — | — | — | V35 | L37 | H38 | R39 |
| 235 | — | — | — | — | — | — | M35 | L37 | H38 | R39 |
| 236 | — | — | — | — | — | — | V35 | L37 | H38 | R39 |
| 237 | — | — | — | — | — | — | V35 | L37 | H38 | R39 |
| 238 | — | — | — | — | — | — | V35 | L37 | H38 | R39 |
| 239 | — | — | — | — | — | — | V35 | L37 | H38 | R39 |
| 240 | — | — | — | — | — | — | L35 | L37 | H38 | R39 |
| 241 | — | — | — | — | — | — | V35 | L37 | H38 | R39 |
| 242 | — | — | — | — | — | — | V35 | L37 | H38 | R39 |
| 243 | — | — | — | — | — | — | V35 | L37 | H38 | R39 |
| 244 | — | — | — | — | — | — | V35 | L37 | H38 | R39 |
| 245 | — | — | — | — | — | — | V35 | L37 | H38 | R39 |
| 246 | — | — | — | — | — | — | V35 | L37 | H38 | R39 |
| 247 | — | — | — | — | — | — | V35 | L37 | H38 | R39 |
| 248 | — | — | — | — | — | — | V35 | L37 | H38 | R39 |
| 249 | — | — | — | — | — | — | V41 | L43 | H44 | R45 |
| 250 | — | — | — | — | — | — | V35 | L37 | H38 | R39 |
| 251 | — | — | — | — | — | — | V25 | L27 | H28 | R29 |
| 252 | — | — | — | — | — | — | V35 | L37 | N38 | R39 |
| 253 | — | — | — | — | — | — | V35 | L37 | N38 | R39 |
| 254 | — | — | — | — | — | — | V35 | L37 | N38 | R39 |
| 255 | — | — | — | — | — | — | V35 | L37 | N38 | R39 |
| 256 | — | — | — | — | — | — | V35 | L37 | N38 | R39 |
| 257 | — | — | — | — | — | — | V35 | L37 | N38 | R39 |
| 258 | — | — | — | — | — | — | V35 | L37 | N38 | R39 |
| 259 | — | — | — | — | — | — | V35 | L37 | N38 | R39 |
| 260 | — | — | — | — | — | — | V35 | L37 | N38 | R39 |
| 261 | — | — | — | — | — | — | V35 | L37 | N38 | R39 |
| 262 | — | — | — | — | — | — | V35 | L37 | N38 | R39 |
| 263 | — | — | — | — | — | — | V35 | L37 | N38 | R39 |
| 264 | — | — | — | — | — | — | V35 | L37 | N38 | R39 |
| 265 | — | — | — | — | — | — | V35 | L37 | N38 | R39 |
| 266 | — | — | — | — | — | — | V35 | L37 | N38 | R39 |
| 267 | — | — | — | — | — | — | V35 | L37 | N38 | R39 |
| 268 | — | — | — | — | — | — | V35 | L37 | N38 | R39 |
| 269 | — | — | — | — | — | — | V35 | L37 | N38 | R39 |
| 270 | — | — | — | — | — | — | V35 | L37 | N38 | R39 |
| 271 | — | — | — | — | — | — | V35 | L37 | N38 | R39 |
| 272 | — | — | — | — | — | — | V35 | L37 | N38 | R39 |
| 273 | — | — | — | — | — | — | V35 | L37 | N38 | R39 |
| 274 | — | — | — | — | — | — | V35 | L37 | N38 | R39 |
| 275 | — | — | — | P117 | G118 | A119 | — | — | — | — |
| 276 | — | — | — | P117 | G118 | A119 | — | — | — | — |
| 277 | — | — | — | P117 | G118 | A119 | — | — | — | — |
| 278 | — | — | — | P117 | G118 | A119 | — | — | — | — |
| 279 | — | — | — | P117 | G118 | A119 | — | — | — | — |
| 280 | — | — | — | P117 | G118 | A119 | — | — | — | — |
| 281 | — | — | — | P117 | G118 | A119 | — | — | — | — |
| 282 | — | — | — | P117 | G118 | A119 | — | — | — | — |
| 283 | — | — | — | P117 | D118 | A119 | — | — | — | — |
| 284 | — | — | — | P117 | G118 | A119 | — | — | — | — |
| 285 | — | — | — | P117 | G118 | A119 | — | — | — | — |
| 286 | — | — | — | P117 | G118 | A119 | — | — | — | — |
| 287 | — | — | — | P117 | G118 | A119 | — | — | — | — |
| 288 | — | — | — | P117 | G118 | A119 | — | — | — | — |
| 289 | — | — | — | P117 | G118 | A119 | — | — | — | — |
| 290 | — | — | — | P117 | G118 | A119 | — | — | — | — |

TABLE 2b-1-continued

| | | | | | | | | | | |
|---|---|---|---|---|---|---|---|---|---|---|
| 291 | — | — | — | P117 | G118 | A119 | — | — | — | — |
| 292 | — | — | — | P120 | G121 | E122 | — | — | — | — |
| 293 | — | — | — | E118 | G119 | A120 | — | — | — | — |
| 294 | — | — | — | E120 | G121 | A122 | — | — | — | — |
| 295 | — | — | — | A119 | G120 | E121 | — | — | — | — |
| 296 | — | — | — | D119 | G120 | E121 | — | — | — | — |
| 297 | — | — | — | D119 | G120 | E121 | — | — | — | — |
| 298 | — | — | — | E119 | G120 | E121 | — | — | — | — |
| 299 | — | — | — | E124 | G125 | E126 | — | — | — | — |
| 300 | — | — | — | E123 | G124 | E125 | — | — | — | — |
| 301 | — | — | — | E119 | G120 | A121 | — | — | — | — |

TABLE 2b-2

| ID | Pos 21 | Pos 22 | Pos 23 | Pos 24 | Pos 25 | Pos 26 | Pos 27 | Pos 28 | Pos 29 | Pos 30 | Pos 31 |
|---|---|---|---|---|---|---|---|---|---|---|---|
| 1 | N227 | S234 | S246 | K259 | P260 | R261 | L295 | Q301 | G308 | S324 | R335 |
| 2 | A178 | S185 | S197 | T205 | P206 | — | H238 | G244 | — | S262 | H273 |
| 3 | E179 | S186 | Q198 | R205 | R206 | — | L238 | E244 | — | F262 | H273 |
| 4 | A178 | S185 | S197 | T205 | P206 | — | H238 | G244 | — | S262 | H273 |
| 5 | E179 | S186 | Q198 | R205 | R206 | — | L238 | E244 | — | F262 | H273 |
| 6 | A187 | S194 | A206 | L215 | P216 | A217 | T254 | P260 | — | H275 | H286 |
| 7 | A180 | G187 | A199 | P205 | K206 | A207 | E240 | E246 | — | A259 | H270 |
| 8 | A184 | S191 | R203 | P209 | R210 | — | T243 | G249 | — | I270 | S281 |
| 9 | E195 | S202 | R214 | R221 | P222 | — | D254 | D260 | — | S276 | P287 |
| 10 | R180 | G187 | R199 | S206 | K207 | Q208 | L241 | N247 | — | T265 | Y276 |
| 11 | A182 | S189 | K201 | K224 | R225 | — | L259 | Q265 | N272 | H289 | H300 |
| 12 | N198 | S205 | T217 | K232 | K233 | Q234 | F268 | P274 | E281 | S299 | C310 |
| 13 | A194 | S201 | S213 | R222 | E223 | W224 | V261 | A267 | — | R281 | P292 |
| 14 | R184 | G191 | R203 | S211 | P212 | — | I244 | E250 | — | T267 | P278 |
| 15 | S192 | S199 | K211 | R234 | P235 | R236 | T270 | Q276 | Q283 | T303 | D314 |
| 16 | S192 | S199 | K211 | R234 | P235 | R236 | T270 | Q276 | Q283 | T303 | D314 |
| 17 | N199 | S206 | A218 | K233 | K234 | G235 | L269 | S275 | E280 | H298 | C309 |
| 18 | A181 | S188 | G200 | — | — | — | T238 | G244 | — | E257 | A268 |
| 19 | N203 | S210 | A222 | K237 | R238 | G239 | L273 | S279 | E284 | H302 | C313 |
| 20 | N197 | S204 | A216 | N231 | K232 | H233 | L267 | H273 | Q280 | D294 | Y305 |
| 21 | E183 | S190 | K202 | E207 | P208 | M210 | V244 | D250 | — | I267 | F278 |
| 22 | N197 | S204 | G216 | N231 | K232 | H233 | L267 | H273 | Q280 | D294 | G305 |
| 23 | E184 | S191 | K203 | E208 | P209 | M211 | V245 | G251 | — | T268 | Y279 |
| 24 | N199 | S206 | A218 | K233 | K234 | R235 | L269 | H275 | E282 | S300 | C311 |
| 25 | N232 | S239 | A251 | R266 | R267 | N268 | L302 | F308 | G315 | T336 | S347 |
| 26 | N169 | S176 | A188 | K203 | K204 | G205 | L239 | S245 | E250 | H268 | C279 |
| 27 | E175 | S182 | — | G194 | P195 | — | L226 | D232 | — | T245 | T256 |
| 28 | R177 | G184 | A196 | G208 | P209 | — | K242 | K248 | — | E265 | Y276 |
| 29 | A180 | G187 | R199 | S206 | K207 | Q208 | I241 | A247 | — | V264 | Y275 |
| 30 | N232 | S239 | A251 | R266 | R267 | N268 | L302 | L308 | G315 | T336 | S347 |
| 31 | Y178 | G185 | A197 | G208 | P209 | — | L242 | E248 | — | T265 | Y276 |
| 32 | A179 | S186 | — | T202 | P203 | — | E236 | D242 | — | Q255 | G266 |
| 33 | Q175 | S182 | — | G194 | P195 | — | L226 | D232 | — | E245 | T256 |
| 34 | E176 | S183 | F195 | — | — | — | Q227 | E233 | — | D246 | D257 |
| 35 | A179 | S186 | K198 | P203 | K204 | — | D236 | G242 | — | Q255 | G266 |
| 36 | N184 | G191 | K203 | G208 | P209 | — | T243 | N249 | — | N262 | Y273 |
| 37 | E187 | G194 | K206 | G221 | P222 | — | T256 | N262 | — | D276 | Y287 |
| 38 | W181 | G188 | K200 | Q206 | P207 | — | L240 | N246 | — | E260 | H271 |
| 39 | E185 | S192 | K204 | G219 | P220 | — | L254 | G260 | — | D274 | Y285 |
| 40 | E185 | S192 | K204 | G219 | P220 | — | L254 | G260 | — | D274 | Y285 |
| 41 | E176 | S183 | — | G195 | P196 | — | L227 | E233 | — | E246 | Y257 |
| 42 | E184 | G191 | K203 | G218 | P219 | — | A252 | K258 | — | E272 | M283 |
| 43 | E185 | S192 | K204 | G219 | P220 | — | T254 | S260 | — | D274 | H285 |
| 44 | E175 | S182 | E194 | — | — | — | L226 | M232 | — | T249 | F260 |
| 45 | E187 | G194 | K206 | G221 | P222 | — | V256 | S262 | — | D276 | Y287 |
| 46 | D177 | S184 | P196 | R202 | K203 | A204 | R238 | G244 | — | P263 | H274 |
| 47 | K178 | S185 | A197 | G207 | P208 | L210 | E243 | A249 | — | S266 | H277 |
| 48 | D183 | G190 | K202 | G207 | P208 | — | F241 | I247 | — | E260 | Y271 |
| 49 | D177 | S184 | P196 | R202 | K203 | A204 | R238 | G244 | — | P263 | H274 |
| 50 | Q179 | S186 | Q198 | T206 | K207 | L208 | E241 | Q247 | — | E264 | H275 |
| 51 | D177 | S184 | P196 | R202 | K203 | A204 | R238 | G244 | — | P263 | H274 |
| 52 | R188 | G195 | K207 | G216 | P217 | — | I250 | P256 | — | I274 | A285 |
| 53 | Q183 | S190 | — | S204 | A205 | G207 | S239 | P245 | — | T258 | D269 |
| 54 | Q201 | S208 | G220 | G229 | P230 | R231 | D265 | E271 | — | Q285 | F296 |
| 55 | Q187 | G194 | K206 | G221 | P222 | — | S255 | K261 | — | D276 | H287 |
| 56 | E176 | S183 | — | G195 | P196 | — | L227 | E233 | — | E246 | Y257 |
| 57 | Q201 | S208 | G220 | G229 | P230 | R231 | D265 | E271 | — | Q285 | F296 |
| 58 | A178 | G185 | R197 | P204 | K205 | I206 | L239 | G245 | — | R262 | Y273 |
| 59 | R184 | G191 | R203 | S211 | P212 | — | 1244 | E250 | — | T267 | P278 |
| 60 | D168 | S175 | S187 | S198 | K199 | R200 | L234 | C240 | G246 | S263 | N274 |
| 61 | N227 | S234 | S246 | K260 | P261 | R262 | L296 | Q302 | G309 | S325 | R336 |

TABLE 2b-2-continued

| | | | | | | | | | | |
|---|---|---|---|---|---|---|---|---|---|---|
| 62 D195 | S202 | P214 | K225 | T226 | R227 | L261 | H267 | N272 | P288 | T299 |
| 63 D195 | S202 | P214 | K225 | T226 | R227 | L261 | H267 | N272 | P288 | T299 |
| 64 N192 | S199 | P211 | K226 | K227 | R228 | L262 | C268 | D275 | S293 | C304 |
| 65 Q189 | S196 | K208 | A214 | F215 | — | I248 | E254 | — | R271 | A282 |
| 66 N232 | S239 | A251 | R266 | R267 | N268 | L302 | F308 | G315 | T336 | S347 |
| 67 N197 | S204 | T216 | G231 | R232 | N233 | L267 | C273 | G280 | S301 | S312 |
| 68 N230 | S237 | A249 | R264 | R265 | N266 | L300 | F306 | G313 | T334 | S345 |
| 69 D199 | S206 | A218 | G233 | R234 | N235 | L269 | C275 | D282 | L303 | S314 |
| 70 N241 | S248 | T260 | G275 | R276 | N277 | L311 | C317 | G324 | S345 | S356 |
| 71 D203 | S210 | R222 | K237 | R238 | — | L272 | L278 | N285 | S306 | — |
| 72 N196 | S203 | T215 | G230 | R231 | N232 | L266 | C272 | G279 | S300 | S311 |
| 73 D177 | S184 | P196 | R202 | K203 | A204 | R238 | G244 | — | P263 | H274 |
| 74 N207 | S214 | T226 | G241 | R242 | D243 | L277 | C283 | G290 | S311 | S322 |
| 75 A178 | S185 | — | P203 | D204 | T205 | H238 | G244 | T245 | S262 | H273 |
| 76 E179 | S186 | — | A203 | P204 | R205 | L238 | E244 | N246 | F262 | H273 |
| 77 I180 | S184 | — | C199 | P200 | G201 | T243 | E249 | — | D264 | L275 |
| 78 M157 | A161 | — | V176 | K177 | G178 | T220 | G226 | — | D242 | L253 |
| 79 S181 | R185 | P207 | T220 | E221 | L222 | K258 | A264 | G266 | D283 | A294 |
| 80 K420 | P428 | E453 | S475 | Q476 | V477 | L521 | D527 | Y531 | D548 | P559 |
| 81 R243 | S250 | A275 | T288 | L289 | K290 | E327 | Q333 | G334 | T350 | E361 |
| 82 E178 | T185 | — | — | — | — | L195 | R201 | — | — | E202 |
| 83 E198 | S206 | V220 | A233 | M234 | E235 | K272 | S278 | K279 | — | P299 |
| 84 — | S63 | V75 | — | — | — | — | — | — | H83 | — |
| 85 — | S63 | V75 | — | — | — | — | — | — | H83 | — |
| 86 — | S63 | V75 | — | — | — | — | — | — | H83 | — |
| 87 — | S63 | V75 | — | — | — | — | — | — | H83 | — |
| 88 — | S63 | V75 | — | — | — | — | — | — | H83 | — |
| 89 — | S63 | V75 | — | — | — | — | — | — | H83 | — |
| 90 — | S63 | V75 | — | — | — | — | — | — | H83 | — |
| 91 — | S63 | V75 | — | — | — | — | — | — | H83 | — |
| 92 — | S63 | V75 | — | — | — | — | — | — | H83 | — |
| 93 — | S63 | V75 | — | — | — | — | — | — | H83 | — |
| 94 — | S63 | V75 | — | — | — | — | — | — | H83 | — |
| 95 — | S63 | V75 | — | — | — | — | — | — | H83 | — |
| 96 — | S63 | V75 | — | — | — | — | — | — | H83 | — |
| 97 — | S63 | V75 | — | — | — | — | — | — | H83 | — |
| 98 — | S63 | V75 | — | — | — | — | — | — | H83 | — |
| 99 — | S63 | V75 | — | — | — | — | — | — | H83 | — |
| 100 — | S63 | V75 | — | — | — | — | — | — | H83 | — |
| 101 — | S63 | V75 | — | — | — | — | — | — | H83 | — |
| 102 — | S63 | V75 | — | — | — | — | — | — | H83 | — |
| 103 — | S63 | V75 | — | — | — | — | — | — | H83 | — |
| 104 — | S63 | V75 | — | — | — | — | — | — | H83 | — |
| 105 — | S63 | V75 | — | — | — | — | — | — | H83 | — |
| 106 — | S63 | V75 | — | — | — | — | — | — | H83 | — |
| 107 — | S63 | V75 | — | — | — | — | — | — | H83 | — |
| 108 — | S63 | V75 | — | — | — | — | — | — | H83 | — |
| 109 — | S63 | V75 | — | — | — | — | — | — | H83 | — |
| 110 — | A63 | V75 | — | — | — | — | — | — | H83 | — |
| 111 — | S63 | V75 | — | — | — | — | — | — | H83 | — |
| 112 — | S63 | V75 | — | — | — | — | — | — | H83 | — |
| 113 — | S63 | V75 | — | — | — | — | — | — | H83 | — |
| 114 — | S63 | V75 | — | — | — | — | — | — | H83 | — |
| 115 — | A63 | V75 | — | — | — | — | — | — | H83 | — |
| 116 — | A63 | V75 | — | — | — | — | — | — | H83 | — |
| 117 — | S63 | V75 | — | — | — | — | — | — | H83 | — |
| 118 — | S63 | V75 | — | — | — | — | — | — | H83 | — |
| 119 — | S63 | V75 | — | — | — | — | — | — | H83 | — |
| 120 — | S63 | V75 | — | — | — | — | — | — | H83 | — |
| 121 — | S63 | V75 | — | — | — | — | — | — | H83 | — |
| 122 — | S63 | V75 | — | — | — | — | — | — | H83 | — |
| 123 — | S63 | V75 | — | — | — | — | — | — | H83 | — |
| 124 — | S63 | V75 | — | — | — | — | — | — | H83 | — |
| 125 — | S63 | V75 | — | — | — | — | — | — | H83 | — |
| 126 — | S63 | V75 | — | — | — | — | — | — | H83 | — |
| 127 — | S63 | V75 | — | — | — | — | — | — | H83 | — |
| 128 — | S63 | V75 | — | — | — | — | — | — | H83 | — |
| 129 — | S63 | V75 | — | — | — | — | — | — | H83 | — |
| 130 — | S63 | V75 | — | — | — | — | — | — | H83 | — |
| 131 — | S63 | V75 | — | — | — | — | — | — | H83 | — |
| 132 — | S63 | V75 | — | — | — | — | — | — | H83 | — |
| 133 — | A63 | V75 | — | — | — | — | — | — | H83 | — |
| 134 — | S63 | V75 | — | — | — | — | — | — | H83 | — |
| 135 — | S63 | V75 | — | — | — | — | — | — | H83 | — |
| 136 — | S63 | V75 | — | — | — | — | — | — | H83 | — |
| 137 — | S63 | V75 | — | — | — | — | — | — | H83 | — |
| 138 — | S63 | V75 | — | — | — | — | — | — | H83 | — |
| 139 — | S63 | V75 | — | — | — | — | — | — | H83 | — |
| 140 — | A63 | V75 | — | — | — | — | — | — | H83 | — |
| 141 — | S63 | V75 | — | — | — | — | — | — | H83 | — |

TABLE 2b-2-continued

| | | | | | | | | | | | |
|---|---|---|---|---|---|---|---|---|---|---|---|
| 142 | — | S63 | V75 | — | — | — | — | — | — | H83 | — |
| 143 | — | S63 | V75 | — | — | — | — | — | — | H83 | — |
| 144 | — | S63 | V75 | — | — | — | — | — | — | H83 | — |
| 145 | — | S63 | V75 | — | — | — | — | — | — | H83 | — |
| 146 | — | S63 | V75 | — | — | — | — | — | — | H83 | — |
| 147 | — | S63 | V75 | — | — | — | — | — | — | H83 | — |
| 148 | — | A63 | V75 | — | — | — | — | — | — | H83 | — |
| 149 | — | S63 | V75 | — | — | — | — | — | — | H83 | — |
| 150 | — | A63 | V75 | — | — | — | — | — | — | H83 | — |
| 151 | — | S63 | V75 | — | — | — | — | — | — | H83 | — |
| 152 | — | S63 | V75 | — | — | — | — | — | — | H83 | — |
| 153 | — | A63 | V75 | — | — | — | — | — | — | H83 | — |
| 154 | — | A63 | V75 | — | — | — | — | — | — | H83 | — |
| 155 | — | S63 | V75 | — | — | — | — | — | — | H83 | — |
| 156 | — | S63 | V75 | — | — | — | — | — | — | H83 | — |
| 157 | — | A63 | V75 | — | — | — | — | — | — | H83 | — |
| 158 | — | S63 | V75 | — | — | — | — | — | — | H83 | — |
| 159 | — | S63 | V75 | — | — | — | — | — | — | H83 | — |
| 160 | — | A63 | V75 | — | — | — | — | — | — | H83 | — |
| 161 | — | A63 | V75 | — | — | — | — | — | — | H83 | — |
| 162 | — | S63 | V75 | — | — | — | — | — | — | H83 | — |
| 163 | — | S63 | V75 | — | — | — | — | — | — | H83 | — |
| 164 | — | S63 | V75 | — | — | — | — | — | — | H83 | — |
| 165 | — | S63 | V75 | — | — | — | — | — | — | H83 | — |
| 166 | — | A63 | V75 | — | — | — | — | — | — | H83 | — |
| 167 | — | S63 | V75 | — | — | — | — | — | — | H83 | — |
| 168 | — | S63 | V75 | — | — | — | — | — | — | N83 | — |
| 169 | — | A63 | V75 | — | — | — | — | — | — | H83 | — |
| 170 | — | S63 | V75 | — | — | — | — | — | — | N83 | — |
| 171 | — | S63 | V75 | — | — | — | — | — | — | H83 | — |
| 172 | — | A63 | V75 | — | — | — | — | — | — | H83 | — |
| 173 | — | A63 | V75 | — | — | — | — | — | — | H83 | — |
| 174 | — | S63 | V75 | — | — | — | — | — | — | H83 | — |
| 175 | — | S55 | V67 | — | — | — | — | — | — | H75 | — |
| 176 | — | S63 | V75 | — | — | — | — | — | — | H83 | — |
| 177 | — | S63 | V75 | — | — | — | — | — | — | H83 | — |
| 178 | — | S63 | V75 | — | — | — | — | — | — | H83 | — |
| 179 | — | A63 | V75 | — | — | — | — | — | — | H83 | — |
| 180 | — | A61 | V73 | — | — | — | — | — | — | H81 | — |
| 181 | — | A63 | V75 | — | — | — | — | — | — | H83 | — |
| 182 | — | A63 | V75 | — | — | — | — | — | — | H83 | — |
| 183 | — | A63 | V75 | — | — | — | — | — | — | H83 | — |
| 184 | E46 | R50 | — | Y59 | G60 | H61 | — | — | A83 | — | K96 |
| 185 | E46 | R50 | — | Y59 | G60 | H61 | — | — | A83 | — | K96 |
| 186 | E46 | R50 | — | Y59 | G60 | H61 | — | — | A83 | — | K96 |
| 187 | E46 | R50 | — | Y59 | G60 | H61 | — | — | A83 | — | K96 |
| 188 | E46 | R50 | — | Y59 | G60 | H61 | — | — | A83 | — | K96 |
| 189 | E46 | R50 | — | Y59 | G60 | H61 | — | — | A83 | — | K96 |
| 190 | E46 | R50 | — | Y59 | G60 | H61 | — | — | A83 | — | K96 |
| 191 | E46 | R50 | — | Y59 | G60 | H61 | — | — | A83 | — | K96 |
| 192 | E46 | R50 | — | Y59 | G60 | H61 | — | — | A83 | — | K96 |
| 193 | E46 | R50 | — | Y59 | G60 | H61 | — | — | A83 | — | K96 |
| 194 | E46 | R50 | — | Y59 | G60 | H61 | — | — | A83 | — | K96 |
| 195 | E46 | R50 | — | Y59 | G60 | H61 | — | — | A83 | — | K96 |
| 196 | E46 | R50 | — | Y59 | G60 | H61 | — | — | A83 | — | K96 |
| 197 | E46 | R50 | — | Y59 | G60 | H61 | — | — | A83 | — | K96 |
| 198 | K46 | R50 | — | Y59 | G60 | H61 | — | — | A83 | — | K96 |
| 199 | E46 | R50 | — | Y59 | G60 | H61 | — | — | A83 | — | K96 |
| 200 | D46 | R50 | — | Y59 | G60 | H61 | — | — | A83 | — | K96 |
| 201 | E26 | R30 | — | Y39 | G40 | H41 | — | — | A63 | — | K76 |
| 202 | D46 | R50 | — | Y59 | G60 | H61 | — | — | A83 | — | K96 |
| 203 | D46 | R50 | — | Y59 | G60 | H61 | — | — | A83 | — | K96 |
| 204 | Q46 | R50 | — | Y59 | G60 | H61 | — | — | A83 | — | K96 |
| 205 | D46 | R50 | — | Y59 | G60 | H61 | — | — | A83 | — | K96 |
| 206 | D46 | R50 | — | Y59 | G60 | H61 | — | — | A83 | — | K96 |
| 207 | D46 | R50 | — | Y59 | G60 | H61 | — | — | A83 | — | K96 |
| 208 | Q46 | R50 | — | Y59 | G60 | H61 | — | — | A83 | — | K96 |
| 209 | D46 | R50 | — | Y59 | G60 | H61 | — | — | A83 | — | K96 |
| 210 | E46 | R50 | — | Y59 | G60 | H61 | — | — | A83 | — | K96 |
| 211 | D46 | R50 | — | Y59 | G60 | H61 | — | — | A83 | — | K96 |
| 212 | Q46 | R50 | — | Y59 | G60 | H61 | — | — | A83 | — | K96 |
| 213 | D46 | R50 | — | Y59 | G60 | H61 | — | — | A83 | — | K96 |
| 214 | D46 | R50 | — | Y59 | G60 | H61 | — | — | A83 | — | K96 |
| 215 | D46 | R50 | — | Y59 | G60 | H61 | — | — | A83 | — | K96 |
| 216 | D46 | R50 | — | Y59 | G60 | H61 | — | — | A83 | — | K96 |
| 217 | D46 | R50 | — | Y59 | G60 | H61 | — | — | A83 | — | K96 |
| 218 | D46 | R50 | — | Y59 | G60 | H61 | — | — | A83 | — | K96 |
| 219 | D46 | R50 | — | Y59 | G60 | H61 | — | — | A83 | — | K96 |
| 220 | D46 | R50 | — | Y59 | G60 | H61 | — | — | A83 | — | K96 |
| 221 | D46 | R50 | — | Y59 | G60 | H61 | — | — | A83 | — | K96 |

TABLE 2b-2-continued

| | | | | | | | | | | | |
|---|---|---|---|---|---|---|---|---|---|---|---|
| 222 | D46 | R50 | — | Y59 | G60 | H61 | — | — | A83 | — | K96 |
| 223 | D46 | R50 | — | Y59 | G60 | H61 | — | — | A83 | — | K96 |
| 224 | D46 | R50 | — | Y59 | G60 | H61 | — | — | A83 | — | K96 |
| 225 | D46 | R50 | — | Y59 | G60 | H61 | — | — | A83 | — | K96 |
| 226 | D46 | R50 | — | Y59 | G60 | H61 | — | — | A83 | — | K96 |
| 227 | D46 | R50 | — | Y59 | G60 | H61 | — | — | A83 | — | K96 |
| 228 | D46 | R50 | — | Y59 | G60 | H61 | — | — | A83 | — | K96 |
| 229 | E46 | R50 | — | Y59 | G60 | H61 | — | — | A83 | — | K96 |
| 230 | D46 | R50 | — | Y59 | G60 | H61 | — | — | A83 | — | K96 |
| 231 | D46 | R50 | — | Y59 | G60 | H61 | — | — | A83 | — | K96 |
| 232 | — | R50 | — | Y59 | G60 | H61 | — | — | A83 | — | K96 |
| 233 | — | S50 | — | Y59 | G60 | H61 | — | — | A83 | — | K96 |
| 234 | — | R50 | — | Y59 | G60 | H61 | — | — | A83 | — | K96 |
| 235 | — | S50 | — | Y59 | G60 | H61 | — | — | A83 | — | K96 |
| 236 | — | S50 | — | Y59 | G60 | H61 | — | — | A83 | — | K96 |
| 237 | — | S50 | — | Y59 | G60 | H61 | — | — | A83 | — | K96 |
| 238 | — | R50 | — | Y59 | G60 | H61 | — | — | A83 | — | K96 |
| 239 | — | S50 | — | Y59 | G60 | H61 | — | — | A83 | — | K96 |
| 240 | — | S50 | — | Y59 | G60 | H61 | — | — | A83 | — | K96 |
| 241 | — | S50 | — | Y59 | G60 | H61 | — | — | A83 | — | K96 |
| 242 | — | S50 | — | Y59 | G60 | H61 | — | — | A83 | — | K96 |
| 243 | — | S50 | — | Y59 | G60 | H61 | — | — | A83 | — | K96 |
| 244 | — | S50 | — | Y59 | G60 | H61 | — | — | A83 | — | K96 |
| 245 | — | R50 | — | Y59 | G60 | H61 | — | — | A83 | — | K96 |
| 246 | — | S50 | — | Y59 | G60 | H61 | — | — | A83 | — | K96 |
| 247 | — | S50 | — | Y59 | G60 | H61 | — | — | A83 | — | K96 |
| 248 | — | S50 | — | Y59 | G60 | H61 | — | — | A83 | — | K96 |
| 249 | — | R56 | — | Y65 | G66 | H67 | — | — | A89 | — | K102 |
| 250 | — | S50 | — | Y59 | G60 | H61 | — | — | A83 | — | K96 |
| 251 | — | R40 | — | Y49 | G50 | H51 | — | — | A73 | — | K86 |
| 252 | — | R50 | — | Y59 | G60 | H61 | — | — | A83 | — | K96 |
| 253 | — | R50 | — | Y59 | G60 | H61 | — | — | A83 | — | K96 |
| 254 | — | R50 | — | Y59 | G60 | H61 | — | — | A83 | — | K96 |
| 255 | — | R50 | — | Y59 | G60 | H61 | — | — | A83 | — | K96 |
| 256 | — | R50 | — | Y59 | G60 | H61 | — | — | A83 | — | K96 |
| 257 | — | R50 | — | Y59 | G60 | H61 | — | — | A83 | — | K96 |
| 258 | — | R50 | — | Y59 | G60 | H61 | — | — | A83 | — | K96 |
| 259 | — | R50 | — | Y59 | G60 | H61 | — | — | A83 | — | K96 |
| 260 | — | R50 | — | Y59 | G60 | H61 | — | — | A83 | — | K96 |
| 261 | — | R50 | — | Y59 | G60 | H61 | — | — | A83 | — | K96 |
| 262 | — | R50 | — | Y59 | G60 | H61 | — | — | A83 | — | K96 |
| 263 | — | R50 | — | Y59 | G60 | H61 | — | — | A83 | — | K96 |
| 264 | — | R50 | — | Y59 | G60 | H61 | — | — | A83 | — | K96 |
| 265 | — | R50 | — | Y59 | G60 | H61 | — | — | A83 | — | K96 |
| 266 | — | R50 | — | Y59 | G60 | H61 | — | — | A83 | — | K96 |
| 267 | — | R50 | — | Y59 | G60 | H61 | — | — | A83 | — | K96 |
| 268 | — | R50 | — | Y59 | G60 | H61 | — | — | A83 | — | K96 |
| 269 | — | R50 | — | Y59 | G60 | H61 | — | — | A83 | — | K96 |
| 270 | — | R50 | — | Y59 | G60 | H61 | — | — | A83 | — | K96 |
| 271 | — | R50 | — | Y59 | G60 | H61 | — | — | A83 | — | K96 |
| 272 | — | R50 | — | Y59 | G60 | H61 | — | — | A83 | — | K96 |
| 273 | — | R50 | — | Y59 | G60 | H61 | — | — | A83 | — | K96 |
| 274 | — | R50 | — | Y59 | G60 | H61 | — | — | A83 | — | K96 |
| 275 | — | G127 | — | — | — | — | Y170 | R176 | G183 | C198 | — |
| 276 | — | G127 | — | — | — | — | Y170 | R176 | G183 | C198 | — |
| 277 | — | G127 | — | — | — | — | Y170 | R176 | G183 | C198 | — |
| 278 | — | G127 | — | — | — | — | Y170 | R176 | G183 | C198 | — |
| 279 | — | G127 | — | — | — | — | Y170 | R176 | G183 | C198 | — |
| 280 | — | G127 | — | — | — | — | Y170 | R176 | G183 | C198 | — |
| 281 | — | G127 | — | — | — | — | Y170 | R176 | G183 | C198 | — |
| 282 | — | G127 | — | — | — | — | Y170 | R176 | G183 | C198 | — |
| 283 | — | G127 | — | — | — | — | Y170 | R176 | G183 | C198 | — |
| 284 | — | G127 | — | — | — | — | Y170 | R176 | G183 | C198 | — |
| 285 | — | G127 | — | — | — | — | Y170 | R176 | G183 | C198 | — |
| 286 | — | G127 | — | — | — | — | Y170 | R176 | G183 | C198 | — |
| 287 | — | G127 | — | — | — | — | Y170 | R176 | G183 | C198 | — |
| 288 | — | G127 | — | — | — | — | Y170 | R176 | G183 | C198 | — |
| 289 | — | G127 | — | — | — | — | Y170 | R176 | G183 | A198 | — |
| 290 | — | G127 | — | — | — | — | Y170 | R176 | G183 | C198 | — |
| 291 | — | G127 | — | — | — | — | Y170 | R176 | G183 | C198 | — |
| 292 | — | G130 | — | — | — | — | Y173 | R179 | G186 | G201 | — |
| 293 | — | G128 | — | — | — | — | Y171 | R177 | G184 | S199 | — |
| 294 | — | G130 | — | — | — | — | Y173 | R179 | G186 | G201 | — |
| 295 | — | G129 | — | — | — | — | Y172 | R178 | G185 | S200 | — |
| 296 | — | G129 | — | — | — | — | Y172 | R178 | G185 | S200 | — |
| 297 | — | G129 | — | — | — | — | Y172 | R178 | G185 | S200 | — |
| 298 | — | G129 | — | — | — | — | Y172 | R178 | G185 | C200 | — |

TABLE 2b-2-continued

| | | | | | | | | | | |
|---|---|---|---|---|---|---|---|---|---|---|
| 299 — | G134 | — | — | — | — | Y177 | R183 | G190 | A205 | — |
| 300 — | G133 | — | — | — | — | Y176 | R182 | G189 | S204 | — |
| 301 — | G129 | — | — | — | — | Y172 | R178 | G185 | S200 | — |

| ID | Pos 32 | Pos 33 | Pos 34 | Pos 35 | Pos 36 | Pos 37 | Pos 38 | Pos 39 | Pos 40 |
|---|---|---|---|---|---|---|---|---|---|
| 1 | G346 | F349 | L351 | D352 | T358 | L384 | L397 | F417 | T418 |
| 2 | D281 | V284 | L286 | A287 | T293 | L319 | L330 | L350 | T351 |
| 3 | H281 | V284 | R286 | R287 | E293 | L319 | L330 | L350 | T351 |
| 4 | D281 | V284 | L286 | A287 | T293 | L319 | L330 | L350 | T351 |
| 5 | H281 | V284 | R286 | R287 | E293 | L319 | L330 | L350 | T351 |
| 6 | D296 | L299 | — | E301 | E307 | L333 | L343 | L363 | S364 |
| 7 | E278 | I281 | — | — | D287 | L313 | L323 | L343 | T344 |
| 8 | S291 | A294 | — | D296 | R302 | L328 | L338 | L358 | T359 |
| 9 | G298 | P301 | — | A303 | E309 | L335 | L345 | L365 | T366 |
| 10 | D286 | L289 | — | E291 | Y297 | L323 | L333 | F353 | T354 |
| 11 | G311 | Y314 | L316 | D317 | V323 | L349 | L362 | F382 | T383 |
| 12 | R321 | F324 | L326 | N327 | S333 | L359 | L372 | Y392 | T393 |
| 13 | D302 | L305 | — | A307 | A313 | L339 | L349 | L369 | T370 |
| 14 | D287 | G290 | S292 | S293 | P299 | L325 | L335 | L355 | T356 |
| 15 | G325 | Y328 | L330 | D331 | I337 | L363 | L377 | F397 | T398 |
| 16 | G325 | Y328 | L330 | D331 | I337 | L363 | L377 | F397 | T398 |
| 17 | G320 | F323 | L325 | N326 | N332 | L358 | L371 | Y391 | T392 |
| 18 | A278 | L281 | — | A283 | V289 | L315 | L325 | L345 | T346 |
| 19 | G324 | F327 | L329 | N330 | N336 | L362 | L375 | Y395 | T396 |
| 20 | G316 | F319 | L321 | N322 | S328 | L354 | L367 | Y387 | T388 |
| 21 | D288 | A291 | — | G293 | P299 | L325 | L335 | T355 | T356 |
| 22 | G316 | F319 | L321 | N322 | T328 | L354 | L367 | Y387 | T388 |
| 23 | D289 | A292 | — | S294 | P300 | L326 | L336 | T356 | I357 |
| 24 | G322 | F325 | L327 | D328 | S334 | L360 | L373 | Y393 | T394 |
| 25 | G358 | V361 | L363 | D364 | D370 | L396 | L410 | Y430 | T431 |
| 26 | G290 | F293 | L295 | N296 | N302 | L328 | L341 | Y361 | T362 |
| 27 | S266 | I269 | — | E271 | Y277 | L300 | L310 | I330 | T331 |
| 28 | S286 | L289 | — | E291 | E297 | L323 | L333 | I353 | R354 |
| 29 | D285 | F288 | — | V290 | Y296 | L322 | L332 | F352 | T353 |
| 30 | G358 | F361 | L363 | D364 | D370 | L396 | L410 | Y430 | T431 |
| 31 | N286 | L289 | — | K291 | E297 | L323 | L333 | I353 | R354 |
| 32 | D276 | L279 | — | H281 | P287 | L313 | L323 | L343 | T344 |
| 33 | S266 | A269 | — | Q271 | Y277 | L299 | L309 | L329 | T330 |
| 34 | F267 | I270 | — | A272 | T278 | L304 | A314 | L334 | T335 |
| 35 | D276 | L279 | — | R281 | P287 | L313 | L323 | L343 | T344 |
| 36 | S283 | L286 | — | D288 | N294 | L320 | L330 | I350 | R351 |
| 37 | D297 | M300 | — | A302 | P308 | L334 | L344 | L364 | R365 |
| 38 | S281 | L284 | — | D286 | P292 | L318 | L328 | L348 | R349 |
| 39 | D295 | M298 | — | G300 | P306 | L332 | L342 | L362 | R363 |
| 40 | D295 | M298 | — | G300 | P306 | L332 | L342 | L362 | R363 |
| 41 | S267 | A270 | — | E272 | D278 | L299 | L309 | L329 | T330 |
| 42 | S293 | M296 | — | A298 | P304 | L330 | L340 | L360 | R361 |
| 43 | D295 | M298 | — | Q300 | P306 | L332 | L342 | L362 | R363 |
| 44 | Y270 | L273 | — | A275 | Q281 | L307 | A317 | T337 | T338 |
| 45 | D297 | M300 | — | G302 | P308 | L334 | L344 | L364 | R365 |
| 46 | P284 | E287 | — | A289 | Y295 | L320 | L330 | Y350 | S351 |
| 47 | D287 | L290 | — | Q292 | P298 | L323 | L333 | L353 | T354 |
| 48 | D281 | L284 | — | R286 | T292 | L318 | L328 | V348 | R349 |
| 49 | P284 | E287 | — | A289 | Y295 | L320 | L330 | Y350 | S351 |
| 50 | D285 | L288 | — | G290 | P296 | L321 | L331 | Y351 | T352 |
| 51 | P284 | E287 | — | A289 | Y295 | L320 | L330 | Y350 | S351 |
| 52 | Q295 | I298 | — | S300 | P306 | L332 | L342 | L362 | T363 |
| 53 | Y279 | L282 | — | R284 | T290 | L316 | A326 | F346 | T347 |
| 54 | D306 | L309 | — | R311 | P317 | V343 | I353 | L373 | R374 |
| 55 | D297 | I300 | — | S302 | P308 | L334 | L344 | L364 | R365 |
| 56 | S267 | A270 | — | E272 | D278 | L299 | L309 | L329 | T330 |
| 57 | D306 | L309 | — | R311 | P317 | V343 | I353 | L373 | R374 |
| 58 | A283 | A286 | — | R288 | V294 | L320 | L330 | L350 | T351 |
| 59 | D287 | G290 | S292 | S293 | P299 | L325 | L335 | L355 | T356 |
| 60 | G285 | F288 | L290 | N291 | S297 | L323 | L336 | Y356 | T357 |
| 61 | G347 | F350 | L352 | D353 | T359 | L385 | L398 | F418 | T419 |
| 62 | G310 | F313 | L315 | D316 | D322 | L348 | L361 | Y381 | T382 |
| 63 | G310 | F313 | L315 | D316 | D322 | L348 | L361 | Y381 | T382 |
| 64 | G315 | F318 | L320 | N321 | D327 | L353 | L366 | Y386 | T387 |
| 65 | A292 | I295 | — | S297 | P303 | L329 | L339 | L359 | T360 |
| 66 | G358 | V361 | L363 | D364 | D370 | L396 | L410 | Y430 | T431 |
| 67 | G323 | F326 | L328 | D329 | D335 | L361 | L375 | Y395 | T396 |
| 68 | G356 | F359 | L361 | D362 | N368 | L394 | L408 | Y428 | T429 |
| 69 | G325 | F328 | L330 | D331 | D337 | L363 | L377 | F397 | T398 |
| 70 | G367 | F370 | L372 | D373 | D379 | L405 | L419 | Y439 | T440 |
| 71 | — | — | — | — | T315 | L341 | L354 | F374 | T375 |
| 72 | G322 | F325 | L327 | D328 | D334 | L360 | L374 | Y394 | T395 |
| 73 | P284 | E287 | — | A289 | Y295 | L320 | L330 | Y350 | S351 |
| 74 | G333 | F336 | L338 | D339 | D345 | L371 | L385 | Y405 | T406 |

TABLE 2b-2-continued

| | | | | | | | | | |
|---|---|---|---|---|---|---|---|---|---|
| 75 | D281 | V284 | L286 | A287 | T293 | L319 | L330 | L350 | T351 |
| 76 | H281 | V284 | R286 | R287 | E293 | L319 | L330 | L350 | T351 |
| 77 | L286 | K289 | H291 | K292 | G298 | F324 | R343 | L363 | D364 |
| 78 | V263 | R266 | Q268 | Q269 | G275 | L301 | V326 | L342 | I343 |
| 79 | A305 | L308 | D310 | R311 | S319 | N364 | V387 | G412 | T413 |
| 80 | A570 | Y573 | L575 | I576 | E584 | A627 | L652 | L702 | E703 |
| 81 | H369 | A372 | S374 | R375 | P381 | L405 | L420 | V440 | T441 |
| 82 | K208 | N211 | V213 | K214 | Y220 | — | — | — | — |
| 83 | T306 | S309 | L311 | P312 | P318 | L345 | L364 | M388 | T389 |
| 84 | — | — | — | W89 | G95 | — | — | Y103 | H104 |
| 85 | — | — | — | W89 | G95 | — | — | Y103 | H104 |
| 86 | — | — | — | W89 | G95 | — | — | Y103 | H104 |
| 87 | — | — | — | W89 | G95 | — | — | Y103 | H104 |
| 88 | — | — | — | W89 | G95 | — | — | Y103 | H104 |
| 89 | — | — | — | W89 | G95 | — | — | Y103 | H104 |
| 90 | — | — | — | W89 | G95 | — | — | Y103 | H104 |
| 91 | — | — | — | W89 | G95 | — | — | Y103 | H104 |
| 92 | — | — | — | W89 | G95 | — | — | Y103 | H104 |
| 93 | — | — | — | W89 | G95 | — | — | Y103 | H104 |
| 94 | — | — | — | W89 | G95 | — | — | Y103 | H104 |
| 95 | — | — | — | W89 | G95 | — | — | Y103 | H104 |
| 96 | — | — | — | W89 | G95 | — | — | Y103 | H104 |
| 97 | — | — | — | W89 | G95 | — | — | Y103 | H104 |
| 98 | — | — | — | W89 | G95 | — | — | Y103 | H104 |
| 99 | — | — | — | W89 | G95 | — | — | Y103 | H104 |
| 100 | — | — | — | W89 | G95 | — | — | Y103 | H104 |
| 101 | — | — | — | W89 | G95 | — | — | Y103 | H104 |
| 102 | — | — | — | W89 | G95 | — | — | Y103 | H104 |
| 103 | — | — | — | W89 | G95 | — | — | Y103 | H104 |
| 104 | — | — | — | W89 | G95 | — | — | Y103 | H104 |
| 105 | — | — | — | W89 | G95 | — | — | Y103 | H104 |
| 106 | — | — | — | W89 | G95 | — | — | Y103 | H104 |
| 107 | — | — | — | W89 | G95 | — | — | Y103 | H104 |
| 108 | — | — | — | W89 | G95 | — | — | Y103 | H104 |
| 109 | — | — | — | W89 | G95 | — | — | Y103 | H104 |
| 110 | — | — | — | W89 | G95 | — | — | Y103 | H104 |
| 111 | — | — | — | W89 | G95 | — | — | Y103 | H104 |
| 112 | — | — | — | — | T88 | — | — | Y103 | H104 |
| 113 | — | — | — | — | I88 | — | — | Y103 | H104 |
| 114 | — | — | — | — | T88 | — | — | Y103 | H104 |
| 115 | — | — | — | — | L88 | — | — | Y103 | H104 |
| 116 | — | — | — | — | L88 | — | — | Y103 | H104 |
| 117 | — | — | — | — | T88 | — | — | Y103 | H104 |
| 118 | — | — | — | — | L88 | — | — | Y103 | H104 |
| 119 | — | — | — | — | L88 | — | — | Y103 | H104 |
| 120 | — | — | — | — | T88 | — | — | Y103 | H104 |
| 121 | — | — | — | — | L88 | — | — | Y103 | H104 |
| 122 | — | — | — | — | T88 | — | — | Y103 | H104 |
| 123 | — | — | — | — | T88 | — | — | Y103 | H104 |
| 124 | — | — | — | — | T88 | — | — | Y103 | H104 |
| 125 | — | — | — | — | L88 | — | — | Y103 | H104 |
| 126 | — | — | — | — | T88 | — | — | Y103 | H104 |
| 127 | — | — | — | — | T88 | — | — | Y103 | H104 |
| 128 | — | — | — | — | L88 | — | — | Y103 | H104 |
| 129 | — | — | — | — | T88 | — | — | Y103 | H104 |
| 130 | — | — | — | — | T88 | — | — | Y103 | H104 |
| 131 | — | — | — | — | T88 | — | — | Y103 | H104 |
| 132 | — | — | — | — | T88 | — | — | Y103 | H104 |
| 133 | — | — | — | — | L88 | — | — | Y103 | H104 |
| 134 | — | — | — | — | T88 | — | — | Y103 | H104 |
| 135 | — | — | — | — | T88 | — | — | Y103 | H104 |
| 136 | — | — | — | — | L88 | — | — | Y103 | H104 |
| 137 | — | — | — | — | T88 | — | — | Y103 | H104 |
| 138 | — | — | — | — | T88 | — | — | Y103 | H104 |
| 139 | — | — | — | — | T88 | — | — | Y103 | H104 |
| 140 | — | — | — | — | L88 | — | — | Y103 | H104 |
| 141 | — | — | — | — | T88 | — | — | Y103 | H104 |
| 142 | — | — | — | — | V88 | — | — | Y103 | H104 |
| 143 | — | — | — | — | T88 | — | — | Y103 | N104 |
| 144 | — | — | — | — | L88 | — | — | Y103 | H104 |
| 145 | — | — | — | — | T88 | — | — | Y103 | H104 |
| 146 | — | — | — | — | T88 | — | — | Y103 | H104 |
| 147 | — | — | — | — | T88 | — | — | Y103 | H104 |
| 148 | — | — | — | — | L88 | — | — | Y103 | H104 |
| 149 | — | — | — | — | T88 | — | — | Y103 | H104 |
| 150 | — | — | — | — | L88 | — | — | Y103 | H104 |
| 151 | — | — | — | — | T88 | — | — | Y103 | H104 |
| 152 | — | — | — | — | T88 | — | — | Y103 | H104 |
| 153 | — | — | — | — | L88 | — | — | Y103 | H104 |
| 154 | — | — | — | — | L88 | — | — | Y103 | H104 |

TABLE 2b-2-continued

| | | | | | | | | | |
|---|---|---|---|---|---|---|---|---|---|
| 155 | — | — | — | — | T88 | — | — | Y103 | H104 |
| 156 | — | — | — | — | L88 | — | — | Y103 | H104 |
| 157 | — | — | — | — | L88 | — | — | Y103 | H104 |
| 158 | — | — | — | — | T88 | — | — | Y103 | H104 |
| 159 | — | — | — | — | T88 | — | — | Y103 | H104 |
| 160 | — | — | — | — | L88 | — | — | Y103 | H104 |
| 161 | — | — | — | — | L88 | — | — | Y103 | H104 |
| 162 | — | — | — | — | T88 | — | — | Y103 | H104 |
| 163 | — | — | — | — | T88 | — | — | Y103 | H104 |
| 164 | — | — | — | — | G88 | — | — | Y103 | H104 |
| 165 | — | — | — | — | T88 | — | — | Y103 | H104 |
| 166 | — | — | — | — | L88 | — | — | Y103 | H104 |
| 167 | — | — | — | — | T88 | — | — | Y103 | H104 |
| 168 | — | — | — | — | L88 | — | — | Y103 | H104 |
| 169 | — | — | — | — | V88 | — | — | Y103 | H104 |
| 170 | — | — | — | — | L88 | — | — | Y103 | H104 |
| 171 | — | — | — | — | L88 | — | — | Y103 | H104 |
| 172 | — | — | — | — | L88 | — | — | Y103 | H104 |
| 173 | — | — | — | — | L88 | — | — | Y103 | H104 |
| 174 | — | — | — | — | L88 | — | — | Y103 | H104 |
| 175 | — | — | — | — | T80 | — | — | Y95 | H96 |
| 176 | — | — | — | — | L88 | — | — | Y103 | H104 |
| 177 | — | — | — | — | L88 | — | — | Y103 | H104 |
| 178 | — | — | — | — | L88 | — | — | Y103 | H104 |
| 179 | — | — | — | — | L88 | — | — | Y103 | H104 |
| 180 | — | — | — | — | T86 | — | — | Y101 | H102 |
| 181 | — | — | — | — | H88 | — | — | Y103 | H104 |
| 182 | — | — | — | — | H88 | — | — | Y103 | H104 |
| 183 | — | — | — | — | L88 | — | — | Y103 | H104 |
| 184 | — | Y104 | R106 | K107 | — | — | — | I139 | K140 |
| 185 | — | Y104 | R106 | K107 | — | — | — | I139 | K140 |
| 186 | — | Y104 | R106 | K107 | — | — | — | I139 | K140 |
| 187 | — | Y104 | R106 | K107 | — | — | — | L139 | K140 |
| 188 | — | Y104 | R106 | K107 | — | — | — | I139 | K140 |
| 189 | — | Y104 | R106 | K107 | — | — | — | L139 | K140 |
| 190 | — | Y104 | R106 | K107 | — | — | — | I139 | K140 |
| 191 | — | Y104 | R106 | K107 | — | — | — | I139 | K140 |
| 192 | — | Y104 | R106 | K107 | — | — | — | L139 | K140 |
| 193 | — | Y104 | R106 | K107 | — | — | — | I139 | K140 |
| 194 | — | Y104 | R106 | K107 | — | — | — | I139 | K140 |
| 195 | — | Y104 | R106 | K107 | — | — | — | I139 | K140 |
| 196 | — | Y104 | R106 | K107 | — | — | — | I139 | K140 |
| 197 | — | Y104 | R106 | K107 | — | — | — | I139 | K140 |
| 198 | — | Y104 | R106 | K107 | — | — | — | I139 | K140 |
| 199 | — | Y104 | R106 | K107 | — | — | — | I139 | K140 |
| 200 | — | Y104 | R106 | K107 | — | — | — | I139 | K140 |
| 201 | — | Y84 | R86 | K87 | — | — | — | I119 | K120 |
| 202 | — | Y104 | R106 | K107 | — | — | — | I139 | K140 |
| 203 | — | Y104 | R106 | K107 | — | — | — | I139 | K140 |
| 204 | — | Y104 | R106 | K107 | — | — | — | I139 | K140 |
| 205 | — | Y104 | R106 | K107 | — | — | — | I139 | K140 |
| 206 | — | Y104 | R106 | K107 | — | — | — | I139 | K140 |
| 207 | — | Y104 | R106 | K107 | — | — | — | I139 | K140 |
| 208 | — | Y104 | R106 | K107 | — | — | — | I139 | K140 |
| 209 | — | Y104 | R106 | K107 | — | — | — | I139 | K140 |
| 210 | — | Y104 | R106 | K107 | — | — | — | I139 | K140 |
| 211 | — | Y104 | R106 | K107 | — | — | — | I139 | K140 |
| 212 | — | Y104 | R106 | K107 | — | — | — | I139 | K140 |
| 213 | — | Y104 | R106 | K107 | — | — | — | I139 | K140 |
| 214 | — | Y104 | R106 | K107 | — | — | — | I139 | K140 |
| 215 | — | Y104 | R106 | K107 | — | — | — | I139 | K140 |
| 216 | — | Y104 | R106 | K107 | — | — | — | I139 | K140 |
| 217 | — | Y104 | R106 | K107 | — | — | — | I139 | K140 |
| 218 | — | Y104 | R106 | K107 | — | — | — | I139 | K140 |
| 219 | — | Y104 | R106 | K107 | — | — | — | I139 | K140 |
| 220 | — | Y104 | R106 | K107 | — | — | — | I139 | K140 |
| 221 | — | Y104 | R106 | K107 | — | — | — | I139 | K140 |
| 222 | — | Y104 | R106 | K107 | — | — | — | I139 | K140 |
| 223 | — | Y104 | R106 | K107 | — | — | — | I139 | K140 |
| 224 | — | Y104 | R106 | K107 | — | — | — | I139 | K140 |
| 225 | — | Y104 | R106 | K107 | — | — | — | I139 | K140 |
| 226 | — | Y104 | R106 | K107 | — | — | — | I139 | K140 |
| 227 | — | Y104 | R106 | K107 | — | — | — | I139 | K140 |
| 228 | — | Y104 | R106 | K107 | — | — | — | I139 | K140 |
| 229 | — | Y104 | R106 | K107 | — | — | — | I139 | Q140 |
| 230 | — | Y104 | R106 | K107 | — | — | — | I139 | K140 |
| 231 | — | Y104 | R106 | K107 | — | — | — | I139 | K140 |
| 232 | — | Y104 | R106 | K107 | — | — | — | I139 | K140 |
| 233 | — | Y104 | R106 | K107 | — | — | — | I139 | K140 |
| 234 | — | Y104 | R106 | K107 | — | — | — | I139 | Q140 |

TABLE 2b-2-continued

| | | | | | | | | | |
|---|---|---|---|---|---|---|---|---|---|
| 235 | — | Y104 | R106 | K107 | — | — | — | I139 | Q140 |
| 236 | — | Y104 | R106 | K107 | — | — | — | I139 | Q140 |
| 237 | — | Y104 | R106 | K107 | — | — | — | I139 | Q140 |
| 238 | — | Y104 | R106 | K107 | — | — | — | I139 | K140 |
| 239 | — | Y104 | R106 | K107 | — | — | — | I139 | Q140 |
| 240 | — | Y104 | R106 | K107 | — | — | — | I139 | Q140 |
| 241 | — | Y104 | R106 | K107 | — | — | — | I139 | Q140 |
| 242 | — | Y104 | R106 | K107 | — | — | — | I139 | Q140 |
| 243 | — | Y104 | R106 | K107 | — | — | — | I139 | Q140 |
| 244 | — | Y104 | R106 | K107 | — | — | — | I139 | Q140 |
| 245 | — | Y104 | R106 | K107 | — | — | — | I139 | Q140 |
| 246 | — | Y104 | R106 | K107 | — | — | — | I139 | Q140 |
| 247 | — | Y104 | R106 | K107 | — | — | — | I139 | Q140 |
| 248 | — | Y104 | R106 | K107 | — | — | — | I139 | Q140 |
| 249 | — | Y110 | R112 | K113 | — | — | — | I145 | K146 |
| 250 | — | Y104 | R106 | K107 | — | — | — | I139 | Q140 |
| 251 | — | Y94 | R96 | K97 | — | — | — | I129 | K130 |
| 252 | — | Y104 | R106 | K107 | — | — | — | I139 | R140 |
| 253 | — | Y104 | R106 | K107 | — | — | — | I139 | R140 |
| 254 | — | Y104 | R106 | K107 | — | — | — | I139 | R140 |
| 255 | — | Y104 | R106 | K107 | — | — | — | I139 | R140 |
| 256 | — | Y104 | R106 | K107 | — | — | — | I139 | R140 |
| 257 | — | Y104 | R106 | K107 | — | — | — | I139 | R140 |
| 258 | — | Y104 | R106 | K107 | — | — | — | I139 | R140 |
| 259 | — | Y104 | R106 | K107 | — | — | — | I139 | R140 |
| 260 | — | Y104 | R106 | K107 | — | — | — | I139 | R140 |
| 261 | — | Y104 | R106 | K107 | — | — | — | I139 | R140 |
| 262 | — | Y104 | R106 | K107 | — | — | — | I139 | R140 |
| 263 | — | Y104 | R106 | K107 | — | — | — | I139 | R140 |
| 264 | — | Y104 | R106 | K107 | — | — | — | I139 | R140 |
| 265 | — | Y104 | R106 | K107 | — | — | — | I139 | R140 |
| 266 | — | Y104 | R106 | K107 | — | — | — | I139 | R140 |
| 267 | — | Y104 | R106 | K107 | — | — | — | I139 | R140 |
| 268 | — | Y104 | R106 | K107 | — | — | — | I139 | R140 |
| 269 | — | Y104 | R106 | K107 | — | — | — | I139 | R140 |
| 270 | — | Y104 | R106 | K107 | — | — | — | I139 | R140 |
| 271 | — | Y104 | R106 | K107 | — | — | — | I139 | R140 |
| 272 | — | Y104 | R106 | K107 | — | — | — | I139 | R140 |
| 273 | — | Y104 | R106 | K107 | — | — | — | I139 | R140 |
| 274 | — | Y104 | R106 | K107 | — | — | — | I139 | R140 |
| 275 | G206 | Y209 | D211 | A212 | E218 | — | R237 | F253 | G254 |
| 276 | G206 | Y209 | D211 | A212 | E218 | — | R237 | F253 | G254 |
| 277 | G206 | Y209 | D211 | A212 | E218 | — | R237 | F253 | G254 |
| 278 | G206 | Y209 | D211 | A212 | G218 | — | R237 | F253 | G254 |
| 279 | G206 | Y209 | E211 | A212 | E218 | — | R237 | F253 | G254 |
| 280 | G206 | Y209 | G211 | A212 | E218 | — | R237 | F253 | G254 |
| 281 | G206 | Y209 | E211 | A212 | E218 | — | R237 | F253 | G254 |
| 282 | G206 | Y209 | D211 | A212 | E218 | — | R237 | F253 | G254 |
| 283 | G206 | Y209 | E211 | A212 | E218 | — | R237 | F253 | G254 |
| 284 | G206 | Y209 | D211 | A212 | E218 | — | R237 | F253 | G254 |
| 285 | G206 | F209 | D211 | A212 | K218 | — | R237 | F253 | G254 |
| 286 | G206 | F209 | D211 | A212 | E218 | — | R237 | F253 | G254 |
| 287 | G206 | F209 | D211 | A212 | E218 | — | R237 | F253 | G254 |
| 288 | G206 | F209 | D211 | A212 | E218 | — | R237 | F253 | G254 |
| 289 | G206 | Y209 | D211 | A212 | E218 | — | R237 | F253 | G254 |
| 290 | G206 | Y209 | D211 | A212 | A218 | — | R237 | F253 | G254 |
| 291 | G206 | Y209 | D211 | A212 | E218 | — | R237 | F253 | G254 |
| 292 | A209 | F212 | D214 | A215 | E221 | — | R240 | F256 | G257 |
| 293 | G207 | F210 | K212 | A213 | E219 | — | R238 | F254 | G255 |
| 294 | G209 | Y212 | D214 | A215 | A221 | — | R240 | F256 | G257 |
| 295 | G208 | Y211 | D213 | A214 | Q220 | — | R239 | F255 | G256 |
| 296 | G208 | Y211 | D213 | A214 | A220 | — | R239 | F255 | G256 |
| 297 | G208 | Y211 | D213 | A214 | A220 | — | R239 | F255 | G256 |
| 298 | G208 | Y211 | D213 | A214 | E220 | — | R239 | F255 | G256 |
| 299 | G213 | Y216 | D218 | A219 | E225 | — | R244 | F260 | G261 |
| 300 | G212 | F215 | D217 | A218 | E224 | — | R243 | F259 | G260 |
| 301 | G208 | Y211 | Q213 | A214 | E220 | — | R239 | F255 | G256 |

TABLE 2b-3

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| 1 | T419 | F420 | A432 | T434 | K438 | L449 | T451 | F462 | Y470 |
| 2 | T352 | F353 | S365 | A367 | Q371 | L382 | V384 | H395 | Y403 |
| 3 | T352 | F353 | L365 | E367 | E371 | L382 | I384 | R395 | Y403 |
| 4 | T352 | F353 | S365 | A367 | Q371 | L382 | V384 | H395 | Y403 |
| 5 | T352 | F353 | L365 | E367 | E371 | L382 | I384 | R395 | Y403 |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| 6 | A365 | F366 | G378 | D380 | L384 | L395 | I397 | R408 | Y416 |
| 7 | V345 | F346 | P358 | T360 | L364 | L375 | I377 | H388 | Y396 |
| 8 | C360 | F361 | W373 | E375 | V379 | L390 | I392 | R403 | Y411 |
| 9 | V367 | M368 | L380 | A382 | L386 | L397 | V399 | F410 | Y418 |
| 10 | L355 | F356 | M368 | K370 | I374 | M385 | I387 | L398 | Y406 |
| 11 | T384 | F385 | A397 | F399 | K403 | V414 | V416 | F427 | Y435 |
| 12 | T394 | F395 | A407 | T409 | K413 | L424 | A426 | Y437 | Y445 |
| 13 | A371 | F372 | G384 | D386 | V390 | L401 | I403 | R414 | Y422 |
| 14 | V357 | F358 | A370 | D372 | E376 | L387 | V389 | R400 | L408 |
| 15 | T399 | F400 | R412 | K414 | L418 | I429 | V431 | Y442 | Y450 |
| 16 | T399 | F400 | R412 | K414 | L418 | I429 | V431 | Y442 | Y450 |
| 17 | T393 | F394 | A406 | T408 | K412 | L423 | V425 | Y436 | Y444 |
| 18 | A347 | F348 | R359 | P361 | E365 | L376 | I378 | L389 | Y397 |
| 19 | T397 | F398 | A410 | T412 | K416 | L427 | V429 | Y440 | Y448 |
| 20 | T389 | F390 | A402 | T404 | R408 | L419 | A421 | Y432 | Y440 |
| 21 | T357 | L358 | R370 | D372 | I376 | L387 | I389 | R400 | Y408 |
| 22 | T389 | F390 | A402 | T404 | T408 | L419 | A421 | F432 | Y440 |
| 23 | T358 | L359 | Q371 | E373 | I377 | L388 | I390 | R401 | Y409 |
| 24 | T395 | F396 | A408 | T410 | K414 | L425 | A427 | Y438 | F446 |
| 25 | T432 | F433 | A445 | T447 | K451 | L462 | V464 | Y475 | Y483 |
| 26 | T363 | F364 | A376 | T378 | K382 | L393 | V395 | Y406 | Y414 |
| 27 | V332 | Y333 | Y345 | D347 | V351 | V362 | I364 | R374 | Y382 |
| 28 | V355 | M356 | K368 | E370 | T374 | M385 | I387 | R398 | Y406 |
| 29 | L354 | F355 | E367 | R369 | L373 | M384 | I386 | F397 | Y405 |
| 30 | T432 | F433 | A445 | T447 | K451 | L462 | V464 | Y475 | Y483 |
| 31 | V355 | M356 | L368 | D370 | V374 | M385 | I387 | K398 | Y406 |
| 32 | A345 | F346 | R357 | D359 | L363 | L374 | I376 | T387 | Y395 |
| 33 | I331 | Y332 | Y344 | D346 | M350 | L361 | L363 | R373 | Y381 |
| 34 | T336 | F337 | H349 | D351 | V355 | Y366 | I368 | R379 | Y387 |
| 35 | A345 | F346 | R357 | D359 | L363 | L374 | I376 | V387 | Y395 |
| 36 | V352 | M353 | C365 | E367 | R371 | L382 | V384 | Y395 | Y403 |
| 37 | S366 | M367 | L379 | D381 | V385 | M396 | I398 | R409 | Y417 |
| 38 | S350 | M351 | L363 | D365 | I369 | L380 | I382 | R393 | Y401 |
| 39 | S364 | M365 | L377 | D379 | T383 | M394 | I396 | R407 | Y415 |
| 40 | S364 | M365 | L377 | D379 | T383 | M394 | I396 | R407 | Y415 |
| 41 | V331 | F332 | L344 | E346 | E350 | L361 | I363 | K373 | Y381 |
| 42 | T362 | M363 | L375 | A377 | Q381 | M392 | I394 | R405 | Y413 |
| 43 | S364 | M365 | L377 | D379 | M383 | M394 | I396 | R407 | Y415 |
| 44 | S339 | F340 | L352 | E354 | E358 | L369 | I371 | G382 | Y390 |
| 45 | S366 | M367 | L379 | D381 | Q385 | M396 | I398 | R409 | Y417 |
| 46 | I352 | F353 | L365 | D367 | S371 | L382 | I384 | R397 | Y405 |
| 47 | C355 | L356 | R368 | E370 | V374 | A385 | L387 | R398 | Y406 |
| 48 | T350 | I351 | K363 | D365 | I369 | L380 | I382 | R393 | Y401 |
| 49 | I352 | F353 | L365 | D367 | S371 | L382 | I384 | R397 | Y405 |
| 31 | V355 | M356 | L368 | D370 | V374 | M385 | I387 | K398 | Y406 |
| 32 | A345 | F346 | R357 | D359 | L363 | L374 | I376 | T387 | Y395 |
| 33 | I331 | Y332 | Y344 | D346 | M350 | L361 | L363 | R373 | Y381 |
| 34 | T336 | F337 | H349 | D351 | V355 | Y366 | I368 | R379 | Y387 |
| 35 | A345 | F346 | R357 | D359 | L363 | L374 | I376 | V387 | Y395 |
| 36 | V352 | M353 | C365 | E367 | R371 | L382 | V384 | Y395 | Y403 |
| 37 | S366 | M367 | L379 | D381 | V385 | M396 | I398 | R409 | Y417 |
| 38 | S350 | M351 | L363 | D365 | I369 | L380 | I382 | R393 | Y401 |
| 39 | S364 | M365 | L377 | D379 | T383 | M394 | I396 | R407 | Y415 |
| 40 | S364 | M365 | L377 | D379 | T383 | M394 | I396 | R407 | Y415 |
| 41 | V331 | F332 | L344 | E346 | E350 | L361 | I363 | K373 | Y381 |
| 42 | T362 | M363 | L375 | A377 | Q381 | M392 | I394 | R405 | Y413 |
| 43 | S364 | M365 | L377 | D379 | M383 | M394 | I396 | R407 | Y415 |
| 44 | S339 | F340 | L352 | E354 | E358 | L369 | I371 | G382 | Y390 |
| 45 | S366 | M367 | L379 | D381 | Q385 | M396 | I398 | R409 | Y417 |
| 46 | I352 | F353 | L365 | D367 | S371 | L382 | I384 | R397 | Y405 |
| 47 | C355 | L356 | R368 | E370 | V374 | A385 | L387 | R398 | Y406 |
| 48 | T350 | I351 | K363 | D365 | I369 | L380 | I382 | R393 | Y401 |
| 49 | I352 | F353 | L365 | D367 | S371 | L382 | I384 | R397 | Y405 |
| 27 | V332 | Y333 | Y345 | D347 | V351 | V362 | I364 | R374 | Y382 |
| 28 | V355 | M356 | K368 | E370 | T374 | M385 | I387 | R398 | Y406 |
| 29 | L354 | F355 | E367 | R369 | L373 | M384 | I386 | F397 | Y405 |
| 30 | T432 | F433 | A445 | T447 | K451 | L462 | V464 | Y475 | Y483 |
| 31 | V355 | M356 | L368 | D370 | V374 | M385 | I387 | K398 | Y406 |
| 32 | A345 | F346 | R357 | D359 | L363 | L374 | I376 | T387 | Y395 |
| 33 | I331 | Y332 | Y344 | D346 | M350 | L361 | L363 | R373 | Y381 |
| 34 | T336 | F337 | H349 | D351 | V355 | Y366 | I368 | R379 | Y387 |
| 35 | A345 | F346 | R357 | D359 | L363 | L374 | I376 | V387 | Y395 |
| 36 | V352 | M353 | C365 | E367 | R371 | L382 | V384 | Y395 | Y403 |
| 37 | S366 | M367 | L379 | D381 | V385 | M396 | I398 | R409 | Y417 |
| 38 | S350 | M351 | L363 | D365 | I369 | L380 | I382 | R393 | Y401 |
| 39 | S364 | M365 | L377 | D379 | T383 | M394 | I396 | R407 | Y415 |
| 40 | S364 | M365 | L377 | D379 | T383 | M394 | I396 | R407 | Y415 |
| 41 | V331 | F332 | L344 | E346 | E350 | L361 | I363 | K373 | Y381 |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| 42 | T362 | M363 | L375 | A377 | Q381 | M392 | I394 | R405 | Y413 |
| 43 | S364 | M365 | L377 | D379 | M383 | M394 | I396 | R407 | Y415 |
| 44 | S339 | F340 | L352 | E354 | E358 | L369 | I371 | G382 | Y390 |
| 45 | S366 | M367 | L379 | D381 | Q385 | M396 | I398 | R409 | Y417 |
| 46 | I352 | F353 | L365 | D367 | S371 | L382 | I384 | R397 | Y405 |
| 47 | C355 | L356 | R368 | E370 | V374 | A385 | L387 | R398 | Y406 |
| 48 | T350 | I351 | K363 | D365 | I369 | L380 | I382 | R393 | Y401 |
| 49 | I352 | F353 | L365 | D367 | S371 | L382 | I384 | R397 | Y405 |
| 35 | A345 | F346 | R357 | D359 | L363 | L374 | I376 | V387 | Y395 |
| 36 | V352 | M353 | C365 | E367 | R371 | L382 | V384 | Y395 | Y403 |
| 37 | S366 | M367 | L379 | D381 | V385 | M396 | I398 | R409 | Y417 |
| 38 | S350 | M351 | L363 | D365 | I369 | L380 | I382 | R393 | Y401 |
| 39 | S364 | M365 | L377 | D379 | T383 | M394 | I396 | R407 | Y415 |
| 40 | S364 | M365 | L377 | D379 | T383 | M394 | I396 | R407 | Y415 |
| 41 | V331 | F332 | L344 | E346 | E350 | L361 | I363 | K373 | Y381 |
| 42 | T362 | M363 | L375 | A377 | Q381 | M392 | I394 | R405 | Y413 |
| 43 | S364 | M365 | L377 | D379 | M383 | M394 | I396 | R407 | Y415 |
| 44 | S339 | F340 | L352 | E354 | E358 | L369 | I371 | G382 | Y390 |
| 45 | S366 | M367 | L379 | D381 | Q385 | M396 | I398 | R409 | Y417 |
| 46 | I352 | F353 | L365 | D367 | S371 | L382 | I384 | R397 | Y405 |
| 47 | C355 | L356 | R368 | E370 | V374 | A385 | L387 | R398 | Y406 |
| 48 | T350 | I351 | K363 | D365 | I369 | L380 | I382 | R393 | Y401 |
| 49 | I352 | F353 | L365 | D367 | S371 | L382 | I384 | R397 | Y405 |
| 50 | C353 | L354 | L366 | E368 | A372 | A383 | V385 | R396 | Y404 |
| 51 | I352 | F353 | L365 | D367 | S371 | L382 | I384 | R397 | Y405 |
| 52 | I364 | F365 | S377 | D379 | E383 | F394 | L396 | R407 | Y415 |
| 53 | T348 | F349 | H361 | D363 | A367 | F378 | I380 | R392 | Y400 |
| 54 | A375 | F376 | W388 | D390 | L394 | L405 | I407 | R418 | Y426 |
| 55 | S366 | M367 | M379 | D381 | L385 | M396 | I398 | R409 | Y417 |
| 56 | V331 | F332 | L344 | E346 | E350 | L361 | I363 | K373 | Y381 |
| 57 | A375 | F376 | W388 | D390 | L394 | L405 | I407 | R418 | Y426 |
| 58 | T352 | F353 | R365 | N367 | I371 | L382 | L384 | R395 | Y403 |
| 59 | V357 | F358 | A370 | D372 | E376 | L387 | V389 | R400 | L408 |
| 60 | T358 | F359 | A371 | R373 | K377 | L388 | T390 | Y401 | Y409 |
| 61 | T420 | F421 | A433 | T435 | K439 | L450 | T452 | F463 | Y471 |
| 62 | T383 | F384 | A396 | T398 | K402 | L413 | V415 | Y426 | Y434 |
| 63 | T383 | F384 | A396 | T398 | K402 | L413 | V415 | Y426 | Y434 |
| 64 | T388 | F389 | A401 | R403 | K407 | L418 | A420 | C431 | Y439 |
| 65 | V361 | F362 | A374 | D376 | L380 | L391 | V393 | R404 | S412 |
| 66 | T432 | F433 | A445 | T447 | K451 | L462 | V464 | Y475 | Y483 |
| 67 | S397 | F398 | A410 | T412 | K416 | L427 | V429 | H440 | Y448 |
| 68 | T430 | F431 | A443 | T445 | K449 | L460 | V462 | Y473 | Y481 |
| 69 | T399 | F400 | A412 | T414 | K418 | L429 | V431 | H442 | Y450 |
| 70 | S441 | F442 | A454 | T456 | K460 | L471 | I473 | H484 | Y492 |
| 71 | T376 | F377 | S389 | L391 | Q395 | L406 | V408 | Y419 | Y427 |
| 72 | S396 | F397 | A409 | T411 | K415 | L426 | V428 | H439 | Y447 |
| 73 | I352 | F353 | L365 | D367 | S371 | L382 | I384 | R397 | Y405 |
| 74 | S407 | F408 | A420 | T422 | K426 | L437 | V439 | H450 | Y458 |
| 75 | T352 | F353 | S365 | A367 | Q371 | L382 | V384 | H395 | Y403 |
| 76 | T352 | F353 | L365 | E367 | E371 | L382 | I384 | R395 | Y403 |
| 77 | D365 | L366 | L378 | I380 | K384 | L395 | N400 | V413 | K432 |
| 78 | G344 | W345 | M357 | L359 | K363 | L374 | N379 | H392 | E411 |
| 79 | I414 | K415 | I437 | L439 | R441 | T452 | H462 | F475 | F495 |
| 80 | T704 | I705 | P718 | M720 | R728 | T753 | R763 | S776 | F795 |
| 81 | V442 | M443 | P456 | E458 | V462 | L473 | I475 | L486 | Y494 |
| 82 | — | L222 | — | — | — | L233 | I235 | — | — |
| 83 | V390 | M391 | P401 | L403 | — | L414 | W416 | E429 | P437 |
| 84 | F105 | V106 | A118 | — | — | — | — | F125 | — |
| 85 | F105 | V106 | A118 | — | — | — | — | F125 | — |
| 86 | F105 | V106 | A118 | — | — | — | — | F125 | — |
| 87 | F105 | V106 | A118 | — | — | — | — | F125 | — |
| 88 | F105 | V106 | A118 | — | — | — | — | F125 | — |
| 89 | F105 | V106 | A118 | — | — | — | — | F125 | — |
| 90 | F105 | V106 | A118 | — | — | — | — | F125 | — |
| 91 | F105 | V106 | A118 | — | — | — | — | F125 | — |
| 92 | F105 | V106 | A118 | — | — | — | — | F125 | — |
| 93 | F105 | V106 | A118 | — | — | — | — | F125 | — |
| 94 | F105 | I106 | A118 | — | — | — | — | F125 | — |
| 95 | L105 | V106 | A118 | — | — | — | — | F125 | — |
| 96 | F105 | V106 | A118 | — | — | — | — | F125 | — |
| 97 | L105 | V106 | A118 | — | — | — | — | F125 | — |
| 98 | F105 | V106 | A118 | — | — | — | — | F125 | — |
| 99 | L105 | V106 | A118 | — | — | — | — | F125 | — |
| 100 | F105 | V106 | A118 | — | — | — | — | F125 | — |
| 101 | F105 | V106 | A118 | — | — | — | — | F125 | — |
| 102 | F105 | V106 | A118 | — | — | — | — | F125 | — |
| 103 | F105 | V106 | A118 | — | — | — | — | F125 | — |
| 104 | F105 | V106 | A118 | — | — | — | — | F125 | — |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| 105 | F105 | V106 | A118 | — | — | — | — | F125 | — |
| 106 | F105 | V106 | A118 | — | — | — | — | F125 | — |
| 107 | F105 | V106 | A118 | — | — | — | — | F125 | — |
| 108 | L105 | V106 | A118 | — | — | — | — | F125 | — |
| 109 | L105 | V106 | A118 | — | — | — | — | F125 | — |
| 110 | L105 | V106 | A118 | — | — | — | — | F125 | — |
| 111 | L105 | V106 | A118 | — | — | — | — | F125 | — |
| 112 | L105 | V106 | A118 | — | — | — | — | F125 | — |
| 113 | F105 | V106 | A118 | — | — | — | — | F125 | — |
| 114 | F105 | V106 | A118 | — | — | — | — | F125 | — |
| 115 | F105 | V106 | A118 | — | — | — | — | F125 | — |
| 116 | L105 | V106 | A118 | — | — | — | — | F125 | — |
| 117 | L105 | V106 | A118 | — | — | — | — | F125 | — |
| 118 | L105 | V106 | A118 | — | — | — | — | F125 | — |
| 119 | F105 | V106 | A118 | — | — | — | — | F125 | — |
| 120 | L105 | V106 | A118 | — | — | — | — | F125 | — |
| 121 | F105 | V106 | A118 | — | — | — | — | F125 | — |
| 122 | L105 | V106 | A118 | — | — | — | — | F125 | — |
| 123 | L105 | V106 | A118 | — | — | — | — | F125 | — |
| 124 | L105 | V106 | A118 | — | — | — | — | F125 | — |
| 125 | F105 | V106 | A118 | — | — | — | — | F125 | — |
| 126 | L105 | V106 | A118 | — | — | — | — | F125 | — |
| 127 | L105 | V106 | A118 | — | — | — | — | F125 | — |
| 128 | F105 | V106 | A118 | — | — | — | — | F125 | — |
| 129 | L105 | V106 | A118 | — | — | — | — | F125 | — |
| 130 | L105 | V106 | A118 | — | — | — | — | F125 | — |
| 131 | F105 | V106 | A118 | — | — | — | — | F125 | — |
| 132 | L105 | V106 | A118 | — | — | — | — | F125 | — |
| 133 | L105 | V106 | A118 | — | — | — | — | F125 | — |
| 134 | L105 | V106 | A118 | — | — | — | — | F125 | — |
| 135 | L105 | V106 | A118 | — | — | — | — | F125 | — |
| 136 | F105 | A106 | A118 | — | — | — | — | F125 | — |
| 137 | L105 | A106 | A118 | — | — | — | — | F125 | — |
| 138 | L105 | V106 | A118 | — | — | — | — | F125 | — |
| 139 | L105 | V106 | A118 | — | — | — | — | F125 | — |
| 140 | L105 | V106 | A118 | — | — | — | — | F125 | — |
| 141 | L105 | V106 | A118 | — | — | — | — | F125 | — |
| 142 | F105 | V106 | A118 | — | — | — | — | F125 | — |
| 143 | L105 | V106 | A118 | — | — | — | — | F125 | — |
| 144 | F105 | V106 | A118 | — | — | — | — | F125 | — |
| 145 | L105 | V106 | A118 | — | — | — | — | F125 | — |
| 146 | L105 | V106 | A118 | — | — | — | — | F125 | — |
| 147 | L105 | V106 | A118 | — | — | — | — | F125 | — |
| 148 | L105 | V106 | A118 | — | — | — | — | F125 | — |
| 149 | L105 | V106 | A118 | — | — | — | — | F125 | — |
| 150 | L105 | V106 | A118 | — | — | — | — | F125 | — |
| 151 | L105 | A106 | A118 | — | — | — | — | F125 | — |
| 152 | L105 | V106 | A118 | — | — | — | — | F125 | — |
| 153 | L105 | I106 | A118 | — | — | — | — | F125 | — |
| 154 | L105 | M106 | A118 | — | — | — | — | F125 | — |
| 155 | L105 | V106 | A118 | — | — | — | — | F125 | — |
| 156 | F105 | V106 | A118 | — | — | — | — | F125 | — |
| 157 | L105 | V106 | A118 | — | — | — | — | F125 | — |
| 158 | L105 | V106 | A118 | — | — | — | — | F125 | — |
| 159 | L105 | A106 | A118 | — | — | — | — | F125 | — |
| 160 | L105 | V106 | A118 | — | — | — | — | F125 | — |
| 161 | L105 | V106 | A118 | — | — | — | — | F125 | — |
| 162 | L105 | V106 | A118 | — | — | — | — | F125 | — |
| 163 | L105 | V106 | A118 | — | — | — | — | F125 | — |
| 164 | F105 | V106 | A118 | — | — | — | — | F125 | — |
| 165 | L105 | A106 | A118 | — | — | — | — | F125 | — |
| 166 | L105 | I106 | A118 | — | — | — | — | F125 | — |
| 167 | L105 | V106 | A118 | — | — | — | — | F125 | — |
| 168 | L105 | V106 | A118 | — | — | — | — | F125 | — |
| 169 | L105 | V106 | A118 | — | — | — | — | F125 | — |
| 170 | L105 | V106 | A118 | — | — | — | — | F125 | — |
| 171 | L105 | V106 | A118 | — | — | — | — | F125 | — |
| 172 | F105 | V106 | A118 | — | — | — | — | F125 | — |
| 173 | F105 | V106 | A118 | — | — | — | — | F125 | — |
| 174 | F105 | V106 | A118 | — | — | — | — | F125 | — |
| 175 | L97 | V98 | A110 | — | — | — | — | F117 | — |
| 176 | F105 | V106 | A118 | — | — | — | — | F125 | — |
| 177 | L105 | V106 | A118 | — | — | — | — | F125 | — |
| 178 | F105 | V106 | P118 | — | — | — | — | F125 | — |
| 179 | F105 | V106 | A118 | — | — | — | — | F125 | — |
| 180 | F103 | V104 | A116 | — | — | — | — | F123 | — |
| 181 | F105 | V106 | A118 | — | — | — | — | F125 | — |
| 182 | F105 | V106 | A118 | — | — | — | — | F125 | — |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| 183 | L105 | F106 | A118 | — | — | — | — | F125 | — |
| 184 | L141 | I142 | G148 | T150 | K154 | A165 | F167 | — | — |
| 185 | L141 | I142 | G148 | T150 | K154 | A165 | F167 | — | — |
| 186 | L141 | I142 | G148 | T150 | K154 | A165 | F167 | — | — |
| 187 | L141 | I142 | G148 | T150 | K154 | A165 | F167 | — | — |
| 188 | L141 | I142 | G148 | T150 | K154 | A165 | F167 | — | — |
| 189 | L141 | I142 | G148 | T150 | K154 | A164 | F166 | — | — |
| 190 | L141 | I142 | G148 | T150 | K154 | A165 | F167 | — | — |
| 191 | L141 | I142 | G148 | T150 | K154 | A165 | F167 | — | — |
| 192 | L141 | I142 | G148 | T150 | K154 | A165 | F167 | — | — |
| 193 | L141 | I142 | G148 | T150 | K154 | E165 | F167 | — | — |
| 194 | L141 | I142 | G148 | T150 | K154 | A165 | F167 | — | — |
| 195 | L141 | I142 | G148 | T150 | K154 | A165 | F167 | — | — |
| 196 | L141 | I142 | G148 | T150 | K154 | A165 | F167 | — | — |
| 197 | L141 | I142 | G148 | T150 | K154 | A165 | F167 | — | — |
| 198 | L141 | I142 | G148 | T150 | K154 | A165 | F167 | — | — |
| 199 | L141 | I142 | G148 | T150 | K154 | A165 | F167 | — | — |
| 200 | L141 | I142 | G148 | T150 | K154 | A165 | F167 | — | — |
| 201 | L121 | I122 | G128 | T130 | K134 | A145 | F147 | — | — |
| 202 | L141 | I142 | G148 | T150 | K154 | A165 | F167 | — | — |
| 203 | L141 | I142 | G148 | T150 | K154 | A165 | F167 | — | — |
| 204 | L141 | I142 | G148 | T150 | K154 | A165 | F167 | — | — |
| 205 | L141 | I142 | G148 | T150 | K154 | A165 | F167 | — | — |
| 206 | L141 | I142 | G148 | T150 | K154 | A165 | F167 | — | — |
| 207 | L141 | I142 | G148 | T150 | K154 | A165 | F167 | — | — |
| 208 | L141 | I142 | G148 | T150 | K154 | A165 | F167 | — | — |
| 209 | L141 | I142 | G148 | T150 | K154 | A165 | F167 | — | — |
| 210 | L141 | I142 | G148 | T150 | K154 | A165 | F167 | — | — |
| 211 | L141 | I142 | G148 | T150 | K154 | A165 | F167 | — | — |
| 212 | L141 | I142 | G148 | T150 | K154 | A165 | F167 | — | — |
| 213 | L141 | I142 | G148 | T150 | K154 | A165 | F167 | — | — |
| 214 | L141 | I142 | G148 | T150 | K154 | A165 | F167 | — | — |
| 215 | L141 | I142 | G148 | T150 | K154 | A165 | F167 | — | — |
| 216 | L141 | I142 | G148 | T150 | K154 | A165 | F167 | — | — |
| 217 | L141 | I142 | G148 | T150 | K154 | A165 | F167 | — | — |
| 218 | F141 | I142 | G148 | T150 | K154 | A165 | F167 | — | — |
| 219 | L141 | I142 | G148 | T150 | K154 | A165 | F167 | — | — |
| 220 | L141 | I142 | G148 | T150 | K154 | T165 | F167 | — | — |
| 221 | L141 | I142 | G148 | T150 | K154 | A165 | F167 | — | — |
| 222 | L141 | I142 | G148 | T150 | K154 | A165 | F167 | — | — |
| 223 | L141 | I142 | G148 | T150 | K154 | T165 | F167 | — | — |
| 224 | L141 | I142 | G148 | T150 | K154 | A165 | F167 | — | — |
| 225 | L141 | I142 | G148 | T150 | K154 | A165 | F167 | — | — |
| 226 | L141 | I142 | G148 | T150 | K154 | A165 | F167 | — | — |
| 227 | L141 | I142 | G148 | T150 | K154 | T165 | F167 | — | — |
| 228 | L141 | I142 | G148 | T150 | K154 | A165 | F167 | — | — |
| 229 | L141 | I142 | G148 | T150 | K154 | A165 | F167 | — | — |
| 230 | L141 | I142 | G148 | T150 | K154 | A165 | F167 | — | — |
| 231 | L141 | I142 | G148 | T150 | K154 | T165 | F167 | — | — |
| 232 | L141 | I142 | G148 | T150 | K154 | A165 | F167 | — | — |
| 233 | L141 | I142 | G148 | T150 | K154 | A165 | F167 | — | — |
| 234 | L141 | I142 | G148 | T150 | K154 | A165 | F167 | — | — |
| 235 | L141 | I142 | G148 | T150 | K154 | A165 | F167 | — | — |
| 236 | L141 | I142 | G148 | T150 | K154 | A165 | F167 | — | — |
| 237 | L141 | I142 | G148 | T150 | K154 | A165 | F167 | — | — |
| 238 | L141 | I142 | G148 | T150 | K154 | T165 | F167 | — | — |
| 239 | L141 | I142 | G148 | T150 | K154 | A165 | F167 | — | — |
| 240 | L141 | I142 | G148 | T150 | K154 | A165 | F167 | — | — |
| 241 | L141 | I142 | G148 | T150 | K154 | A165 | F167 | — | — |
| 242 | L141 | I142 | G148 | T150 | K154 | A165 | F167 | — | — |
| 243 | L141 | I142 | G148 | T150 | K154 | A165 | F167 | — | — |
| 244 | L141 | I142 | G148 | T150 | K154 | A165 | F167 | — | — |
| 245 | L141 | I142 | G148 | T150 | K154 | A165 | F167 | — | — |
| 246 | L141 | I142 | G148 | T150 | K154 | A165 | F167 | — | — |
| 247 | L141 | I142 | G148 | T150 | K154 | A165 | F167 | — | — |
| 248 | L141 | I142 | G148 | T150 | K154 | A165 | F167 | — | — |
| 249 | L147 | I148 | G154 | T156 | K160 | T171 | F173 | — | — |
| 250 | L141 | I142 | G148 | T150 | K154 | A165 | F167 | — | — |
| 251 | L131 | I132 | G138 | T140 | K144 | A155 | F157 | — | — |
| 252 | L141 | I142 | G148 | T150 | K154 | A165 | F167 | — | — |
| 253 | L141 | I142 | G148 | T150 | K154 | A165 | F167 | — | — |
| 254 | L141 | I142 | G148 | T150 | K154 | A165 | F167 | — | — |
| 255 | L141 | I142 | G148 | T150 | K154 | A165 | F167 | — | — |
| 256 | L141 | I142 | G148 | T150 | K154 | A165 | F167 | — | — |
| 257 | L141 | I142 | G148 | T150 | K154 | A165 | F167 | — | — |
| 258 | L141 | I142 | G148 | T150 | K154 | A165 | F167 | — | — |
| 259 | L141 | I142 | G148 | T150 | K154 | A165 | F167 | — | — |
| 260 | L141 | I142 | G148 | T150 | K154 | A165 | F167 | — | — |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| 261 | L141 | I142 | G148 | T150 | K154 | A165 | F167 | — | — |
| 262 | L141 | I142 | G148 | T150 | K154 | A164 | F166 | — | — |
| 263 | L141 | I142 | G148 | T150 | K154 | A165 | F167 | — | — |
| 264 | L141 | I142 | G148 | T150 | K154 | S165 | F167 | — | — |
| 265 | L141 | I142 | G148 | T150 | K154 | A165 | F167 | — | — |
| 266 | L141 | I142 | G148 | T150 | K154 | A165 | F167 | — | — |
| 267 | L141 | I142 | G148 | T150 | K154 | S165 | F167 | — | — |
| 268 | L141 | I142 | G148 | T150 | K154 | A165 | F167 | — | — |
| 269 | L141 | I142 | G148 | T150 | K154 | A165 | F167 | — | — |
| 270 | L141 | I142 | G148 | T150 | K154 | A165 | F167 | — | — |
| 271 | L141 | I142 | G148 | T150 | K154 | A165 | F167 | — | — |
| 272 | L141 | I142 | G148 | T150 | K154 | A165 | F167 | — | — |
| 273 | L141 | I142 | G148 | T150 | K154 | A165 | F167 | — | — |
| 274 | L141 | I142 | G148 | T150 | K154 | A165 | F167 | — | — |
| 275 | L255 | Q256 | M268 | — | — | — | — | — | W274 |
| 276 | L255 | Q256 | M268 | — | — | — | — | — | W274 |
| 277 | L255 | Q256 | M268 | — | — | — | — | — | W274 |
| 278 | L255 | Q256 | M268 | — | — | — | — | — | W274 |
| 279 | L255 | Q256 | M268 | — | — | — | — | — | W274 |
| 280 | L255 | Q256 | M268 | — | — | — | — | — | W274 |
| 281 | L255 | Q256 | M268 | — | — | — | — | — | W274 |
| 282 | L255 | Q256 | M268 | — | — | — | — | — | W274 |
| 283 | L255 | Q256 | M268 | — | — | — | — | — | W274 |
| 284 | L255 | Q256 | M268 | — | — | — | — | — | W274 |
| 285 | L255 | Q256 | M268 | — | — | — | — | — | W274 |
| 286 | L255 | Q256 | M268 | — | — | — | — | — | W274 |
| 287 | L255 | Q256 | M268 | — | — | — | — | — | W274 |
| 288 | L255 | Q256 | M268 | — | — | — | — | — | W274 |
| 289 | L255 | Q256 | M268 | — | — | — | — | — | W274 |
| 290 | L255 | Q256 | M268 | — | — | — | — | — | W274 |
| 291 | L255 | Q256 | M268 | — | — | — | — | — | W274 |
| 292 | L258 | Q259 | M271 | — | — | — | — | — | W277 |
| 293 | L256 | Q257 | M269 | — | — | — | — | — | W275 |
| 294 | L258 | Q259 | M271 | — | — | — | — | — | W277 |
| 295 | L257 | Q258 | M270 | — | — | — | — | — | W276 |
| 296 | L257 | Q258 | M270 | — | — | — | — | — | W276 |
| 297 | L257 | Q258 | M270 | — | — | — | — | — | W276 |
| 298 | L257 | Q258 | M270 | — | — | — | — | — | W276 |
| 299 | L262 | Q263 | M275 | — | — | — | — | — | W281 |
| 300 | L261 | Q262 | M274 | — | — | — | — | — | W280 |
| 301 | L257 | Q258 | L270 | — | — | — | — | — | W276 |

| ID | Pos 50 | Pos 51 | Pos 52 | Pos 53 | Pos 54 | Pos 55 | Pos 56 |
|---|---|---|---|---|---|---|---|
| 1 | S476 | V477 | D482 | Y493 | K498 | E515 | K528 |
| 2 | T409 | V410 | D415 | F426 | R431 | D448 | H461 |
| 3 | A409 | V410 | H415 | L426 | M431 | R448 | G461 |
| 4 | T409 | V410 | D415 | F426 | R431 | D448 | H461 |
| 5 | A409 | V410 | H415 | L426 | M431 | R448 | G461 |
| 6 | E422 | L423 | S428 | L439 | R444 | E461 | — |
| 7 | K402 | V403 | T408 | L419 | R424 | N441 | — |
| 8 | Q417 | R418 | D423 | L434 | R439 | Q456 | — |
| 9 | H424 | F425 | A430 | M441 | R446 | E463 | — |
| 10 | E412 | H413 | E418 | L429 | R434 | K451 | — |
| 11 | E441 | F442 | E447 | Y458 | R463 | E480 | K493 |
| 12 | A451 | V452 | D457 | Y468 | K473 | D490 | K503 |
| 13 | A428 | R429 | D434 | L445 | R450 | E467 | — |
| 14 | E414 | T415 | R420 | L429 | L434 | E451 | — |
| 15 | N456 | V457 | Q462 | Y473 | R478 | E495 | K508 |
| 16 | N456 | V457 | Q462 | Y473 | R478 | E495 | K508 |
| 17 | S450 | V451 | D456 | Y467 | R472 | D489 | K502 |
| 18 | Q403 | R404 | H409 | L420 | Q425 | R442 | — |
| 19 | S454 | V455 | D460 | Y471 | R476 | D493 | K506 |
| 20 | S446 | V447 | D452 | F463 | K468 | D485 | T498 |
| 21 | E414 | R415 | V420 | F431 | R436 | E453 | A466 |
| 22 | S446 | V447 | D452 | Y463 | R468 | D485 | S498 |
| 23 | E415 | R416 | E421 | L432 | R437 | E454 | A467 |
| 24 | S452 | V453 | D458 | Y469 | K474 | D491 | K504 |
| 25 | S489 | V490 | E495 | Y506 | K511 | D528 | N541 |
| 26 | S420 | V421 | D426 | Y437 | R442 | D459 | K472 |
| 27 | R388 | Y389 | N394 | L405 | L410 | K427 | V440 |
| 28 | E412 | K413 | F418 | F429 | Y434 | E451 | — |
| 29 | E411 | H412 | D417 | I428 | R433 | N450 | — |
| 30 | S489 | V490 | E495 | Y506 | K511 | D528 | N541 |
| 31 | E412 | R413 | F418 | L429 | Y434 | R451 | — |
| 32 | D401 | R402 | D407 | F418 | R423 | Q440 | — |
| 33 | R387 | Y388 | E393 | I404 | L409 | Q426 | — |
| 34 | P393 | L394 | S399 | V408 | H413 | V430 | — |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| | | 35 | D401 | R402 | D407 | F418 | Q423 | Q440 | — |
| | | 36 | K409 | L410 | E415 | I426 | L431 | R448 | — |
| | | 37 | R423 | R424 | E429 | L440 | Y445 | D462 | — |
| | | 38 | D407 | K408 | E413 | L424 | Y429 | E446 | — |
| | | 39 | T421 | R422 | E427 | L438 | Y443 | G460 | — |
| | | 40 | T421 | R422 | E427 | L438 | Y443 | G460 | — |
| | | 41 | R387 | F388 | Q393 | L404 | L409 | Q426 | — |
| | | 42 | A419 | R420 | E425 | L436 | F441 | S458 | — |
| | | 43 | K421 | R422 | Q427 | L438 | Y443 | D460 | — |
| | | 44 | K395 | K396 | S401 | F411 | T416 | L433 | — |
| | | 45 | K423 | R424 | L429 | L440 | Y445 | N462 | — |
| | | 46 | L411 | R412 | R417 | L428 | H433 | R450 | A463 |
| | | 47 | E412 | R413 | E418 | L429 | Y434 | E451 | A464 |
| | | 48 | K407 | I408 | E413 | I424 | L429 | D446 | — |
| | | 49 | L411 | R412 | R417 | L428 | H433 | R450 | A463 |
| | | 31 | E412 | R413 | F418 | L429 | Y434 | R451 | — |
| | | 32 | D401 | R402 | D407 | F418 | R423 | Q440 | — |
| | | 33 | R387 | Y388 | E393 | I404 | L409 | Q426 | — |
| | | 34 | P393 | L394 | S399 | V408 | H413 | V430 | — |
| | | 35 | D401 | R402 | D407 | F418 | Q423 | Q440 | — |
| | | 36 | K409 | L410 | E415 | I426 | L431 | R448 | — |
| | | 37 | R423 | R424 | E429 | L440 | Y445 | D462 | — |
| | | 38 | D407 | K408 | E413 | L424 | Y429 | E446 | — |
| | | 39 | T421 | R422 | E427 | L438 | Y443 | G460 | — |
| | | 40 | T421 | R422 | E427 | L438 | Y443 | G460 | — |
| | | 41 | R387 | F388 | Q393 | L404 | L409 | Q426 | — |
| | | 42 | A419 | R420 | E425 | L436 | F441 | S458 | — |
| | | 43 | K421 | R422 | Q427 | L438 | Y443 | D460 | — |
| | | 44 | K395 | K396 | S401 | F411 | T416 | L433 | — |
| | | 45 | K423 | R424 | L429 | L440 | Y445 | N462 | — |
| | | 46 | L411 | R412 | R417 | L428 | H433 | R450 | A463 |
| | | 47 | E412 | R413 | E418 | L429 | Y434 | E451 | A464 |
| | | 48 | K407 | I408 | E413 | I424 | L429 | D446 | — |
| | | 49 | L411 | R412 | R417 | L428 | H433 | R450 | A463 |
| | | 27 | R388 | Y389 | N394 | L405 | L410 | K427 | V440 |
| | | 28 | E412 | K413 | F418 | F429 | Y434 | E451 | — |
| | | 29 | E411 | H412 | D417 | I428 | R433 | N450 | — |
| | | 30 | S489 | V490 | E495 | Y506 | K511 | D528 | N541 |
| | | 31 | E412 | R413 | F418 | L429 | Y434 | R451 | — |
| | | 32 | D401 | R402 | D407 | F418 | R423 | Q440 | — |
| | | 33 | R387 | Y388 | E393 | I404 | L409 | Q426 | — |
| | | 34 | P393 | L394 | S399 | V408 | H413 | V430 | — |
| | | 35 | D401 | R402 | D407 | F418 | Q423 | Q440 | — |
| | | 36 | K409 | L410 | E415 | I426 | L431 | R448 | — |
| | | 37 | R423 | R424 | E429 | L440 | Y445 | D462 | — |
| | | 38 | D407 | K408 | E413 | L424 | Y429 | E446 | — |
| | | 39 | T421 | R422 | E427 | L438 | Y443 | G460 | — |
| | | 40 | T421 | R422 | E427 | L438 | Y443 | G460 | — |
| | | 41 | R387 | F388 | Q393 | L404 | L409 | Q426 | — |
| | | 42 | A419 | R420 | E425 | L436 | F441 | 5458 | — |
| | | 43 | K421 | R422 | Q427 | L438 | Y443 | D460 | — |
| | | 44 | K395 | K396 | S401 | F411 | T416 | L433 | — |
| | | 45 | K423 | R424 | L429 | L440 | Y445 | N462 | — |
| | | 46 | L411 | R412 | R417 | L428 | H433 | R450 | A463 |
| | | 47 | E412 | R413 | E418 | L429 | Y434 | E451 | A464 |
| | | 48 | K407 | 1408 | E413 | 1424 | L429 | D446 | — |
| | | 49 | L411 | R412 | R417 | L428 | H433 | R450 | A463 |
| | | 35 | D401 | R402 | D407 | F418 | Q423 | Q440 | — |
| | | 36 | K409 | L410 | E415 | I426 | L431 | R448 | — |
| | | 37 | R423 | R424 | E429 | L440 | Y445 | D462 | — |
| | | 38 | D407 | K408 | E413 | L424 | Y429 | E446 | — |
| | | 39 | T421 | R422 | E427 | L438 | Y443 | G460 | — |
| | | 40 | T421 | R422 | E427 | L438 | Y443 | G460 | — |
| | | 41 | R387 | F388 | Q393 | L404 | L409 | Q426 | — |
| | | 42 | A419 | R420 | E425 | L436 | F441 | S458 | — |
| | | 43 | K421 | R422 | Q427 | L438 | Y443 | D460 | — |
| | | 44 | K395 | K396 | S401 | F411 | T416 | L433 | — |
| | | 45 | K423 | R424 | L429 | L440 | Y445 | N462 | — |
| | | 46 | L411 | R412 | R417 | L428 | H433 | R450 | A463 |
| | | 47 | E412 | R413 | E418 | L429 | Y434 | E451 | A464 |
| | | 48 | K407 | I408 | E413 | I424 | L429 | D446 | — |
| | | 49 | L411 | R412 | R417 | L428 | H433 | R450 | A463 |
| | | 50 | E410 | R411 | D416 | L427 | Y432 | E449 | — |
| | | 51 | L411 | R412 | R417 | L428 | H433 | R450 | A463 |
| | | 52 | S421 | R422 | R427 | L436 | L441 | K458 | — |
| | | 53 | S406 | A407 | K412 | V421 | Y426 | D443 | — |
| | | 54 | G432 | R433 | E438 | L449 | Y454 | D471 | P484 |
| | | 55 | E423 | R424 | E429 | L440 | Y445 | D462 | — |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| | | 56 | R387 | F388 | Q393 | L404 | L409 | Q426 | — |
| | | 57 | G432 | R433 | E438 | L449 | Y454 | D471 | P484 |
| | | 58 | E409 | I410 | D415 | F426 | R431 | E448 | — |
| | | 59 | E414 | T415 | R420 | L429 | L434 | E451 | — |
| | | 60 | S415 | V416 | E421 | Y432 | K437 | E454 | K467 |
| | | 61 | S477 | V478 | D483 | Y494 | K499 | E516 | K529 |
| | | 62 | S440 | V441 | A446 | Y457 | K462 | D479 | N492 |
| | | 63 | S440 | V441 | A446 | Y457 | K462 | D479 | N492 |
| | | 64 | S445 | V446 | D451 | Y462 | K467 | D484 | T497 |
| | | 65 | E418 | R419 | E424 | L433 | L438 | E455 | — |
| | | 66 | S489 | V490 | E495 | Y506 | K511 | D528 | N541 |
| | | 67 | L454 | V455 | A460 | Y471 | K476 | D493 | D506 |
| | | 68 | S487 | V488 | E493 | Y504 | K509 | E526 | N539 |
| | | 69 | L456 | A457 | G462 | Y473 | K478 | D495 | — |
| | | 70 | L498 | V499 | A504 | Y515 | K520 | E537 | D550 |
| | | 71 | S433 | V434 | D439 | F450 | R455 | D472 | T485 |
| | | 72 | L453 | V454 | A459 | Y470 | K475 | D492 | D505 |
| | | 73 | L411 | R412 | R417 | L428 | H433 | R450 | A463 |
| | | 74 | L464 | V465 | A470 | Y481 | M486 | K493 | — |
| | | 75 | T409 | V410 | D415 | F426 | R431 | D448 | T453 |
| | | 76 | A409 | V410 | H415 | L426 | M431 | R448 | G468 |
| | | 77 | N438 | D439 | L444 | F449 | T454 | R474 | N481 |
| | | 78 | D417 | H418 | L423 | F433 | T438 | — | — |
| | | 79 | A501 | R502 | L507 | M519 | A524 | E542 | K569 |
| | | 80 | K816 | R817 | L822 | L836 | Q843 | R871 | K898 |
| | | 81 | T500 | R501 | H506 | V519 | M524 | R541 | R565 |
| | | 82 | — | — | — | — | — | — | — |
| | | 83 | E443 | R444 | R449 | V463 | V468 | — | M494 |
| | | 84 | — | — | — | L137 | — | V140 | — |
| | | 85 | — | — | — | L137 | — | V140 | — |
| | | 86 | — | — | — | L137 | — | V140 | — |
| | | 87 | — | — | — | L137 | — | V140 | — |
| | | 88 | — | — | — | L137 | — | V140 | — |
| | | 89 | — | — | — | L137 | — | V140 | — |
| | | 90 | — | — | — | L137 | — | V140 | — |
| | | 91 | — | — | — | L137 | — | V140 | — |
| | | 92 | — | — | — | L137 | — | V140 | — |
| | | 93 | — | — | — | L137 | — | V140 | — |
| | | 94 | — | — | — | L137 | — | V140 | — |
| | | 95 | — | — | — | L137 | — | V140 | — |
| | | 96 | — | — | — | L137 | — | V140 | — |
| | | 97 | — | — | — | L137 | — | V140 | — |
| | | 98 | — | — | — | L137 | — | V140 | — |
| | | 99 | — | — | — | L137 | — | V140 | — |
| | | 100 | — | — | — | L137 | — | V140 | — |
| | | 101 | — | — | — | L137 | — | I140 | — |
| | | 102 | — | — | — | L137 | — | I140 | — |
| | | 103 | — | — | — | L137 | — | V140 | — |
| | | 104 | — | — | — | L137 | — | I140 | — |
| | | 105 | — | — | — | L137 | — | V140 | — |
| | | 106 | — | — | — | L137 | — | V140 | — |
| | | 107 | — | — | — | L137 | — | I140 | — |
| | | 108 | — | — | — | L137 | — | V140 | — |
| | | 109 | — | — | — | L137 | — | V140 | — |
| | | 110 | — | — | — | L137 | — | V140 | — |
| | | 111 | — | — | — | L137 | — | V140 | — |
| | | 112 | — | — | — | L137 | — | V140 | — |
| | | 113 | — | — | — | L137 | — | I140 | — |
| | | 114 | — | — | — | L137 | — | V140 | — |
| | | 115 | — | — | — | L137 | — | V140 | — |
| | | 116 | — | — | — | L137 | — | V140 | — |
| | | 117 | — | — | — | L137 | — | V140 | — |
| | | 118 | — | — | — | L137 | — | V140 | — |
| | | 119 | — | — | — | L137 | — | V140 | — |
| | | 120 | — | — | — | L137 | — | V140 | — |
| | | 121 | — | — | — | L137 | — | V140 | — |
| | | 122 | — | — | — | L137 | — | V140 | — |
| | | 123 | — | — | — | L137 | — | V140 | — |
| | | 124 | — | — | — | L137 | — | V140 | — |
| | | 125 | — | — | — | L137 | — | I140 | — |
| | | 126 | — | — | — | L137 | — | V140 | — |
| | | 127 | — | — | — | L137 | — | V140 | — |
| | | 128 | — | — | — | L137 | — | V140 | — |
| | | 129 | — | — | — | L137 | — | V140 | — |
| | | 130 | — | — | — | L137 | — | V140 | — |
| | | 131 | — | — | — | L137 | — | V140 | — |
| | | 132 | — | — | — | L137 | — | V140 | — |
| | | 133 | — | — | — | L137 | — | V140 | — |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| 134 | | | — | — | — | L137 | — | V140 | — |
| 135 | | | — | — | — | L137 | — | V140 | — |
| 136 | | | — | — | — | L137 | — | V140 | — |
| 137 | | | — | — | — | L137 | — | V140 | — |
| 138 | | | — | — | — | L137 | — | V140 | — |
| 139 | | | — | — | — | L137 | — | V140 | — |
| 140 | | | — | — | — | L137 | — | V140 | — |
| 141 | | | — | — | — | L137 | — | V140 | — |
| 142 | | | — | — | — | L137 | — | V140 | — |
| 143 | | | — | — | — | L137 | — | V140 | — |
| 144 | | | — | — | — | L137 | — | V140 | — |
| 145 | | | — | — | — | L137 | — | V140 | — |
| 146 | | | — | — | — | L137 | — | V140 | — |
| 147 | | | — | — | — | L137 | — | V140 | — |
| 148 | | | — | — | — | L137 | — | V140 | — |
| 149 | | | — | — | — | L137 | — | V140 | — |
| 150 | | | — | — | N130 | L137 | — | V140 | — |
| 151 | | | — | — | N130 | L137 | — | V140 | — |
| 152 | | | — | — | N130 | L137 | — | V140 | — |
| 153 | | | — | — | N130 | L137 | — | V140 | — |
| 154 | | | — | — | N130 | L137 | — | V140 | — |
| 155 | | | — | — | N130 | L137 | — | V140 | — |
| 156 | | | — | — | N130 | L137 | — | V140 | — |
| 157 | | | — | — | N130 | L137 | — | V140 | — |
| 158 | | | — | — | N130 | L137 | — | V140 | — |
| 159 | | | — | — | N130 | L137 | — | V140 | — |
| 160 | | | — | — | N130 | L137 | — | V140 | — |
| 161 | | | — | — | N130 | L137 | — | V140 | — |
| 162 | | | — | — | N130 | L137 | — | V140 | — |
| 163 | | | — | — | N130 | L137 | — | V140 | — |
| 164 | | | — | — | N130 | L137 | — | V140 | — |
| 165 | | | — | — | N130 | L137 | — | V140 | — |
| 166 | | | — | — | N130 | L137 | — | V140 | — |
| 167 | | | — | — | N130 | L137 | — | V140 | — |
| 168 | | | — | — | N130 | L137 | — | I140 | — |
| 169 | | | — | — | N130 | L137 | — | V140 | — |
| 170 | | | — | — | N130 | L137 | — | I140 | — |
| 171 | | | — | — | N130 | L137 | — | V140 | — |
| 172 | | | — | — | N130 | L137 | — | V140 | — |
| 173 | | | — | — | N130 | L137 | — | I140 | — |
| 174 | | | — | — | N130 | L137 | — | V140 | — |
| 175 | | | — | — | N122 | L129 | — | V132 | — |
| 176 | | | — | — | N130 | L137 | — | V140 | — |
| 177 | | | — | — | N130 | L137 | — | V140 | — |
| 178 | | | — | — | N130 | L137 | — | V140 | — |
| 179 | | | — | — | N130 | L137 | — | V140 | — |
| 180 | | | — | — | N128 | L135 | — | I138 | — |
| 181 | | | — | — | N130 | L137 | — | V140 | — |
| 182 | | | — | — | N130 | L137 | — | V140 | — |
| 183 | | | — | — | N130 | L137 | — | V140 | — |
| 184 | | | — | — | — | — | — | — | K181 |
| 185 | | | — | — | — | — | — | — | K181 |
| 186 | | | — | — | — | — | — | — | K181 |
| 187 | | | — | — | — | — | — | — | K181 |
| 188 | | | — | — | — | — | — | — | K181 |
| 189 | | | — | — | — | — | — | — | K180 |
| 190 | | | — | — | — | — | — | — | K181 |
| 191 | | | — | — | — | — | — | — | K181 |
| 192 | | | — | — | — | — | — | — | K181 |
| 193 | | | — | — | — | — | — | — | K181 |
| 194 | | | — | — | — | — | — | — | K181 |
| 195 | | | — | — | — | — | — | — | K181 |
| 196 | | | — | — | — | — | — | — | K181 |
| 197 | | | — | — | — | — | — | — | K181 |
| 198 | | | — | — | — | — | — | — | K181 |
| 199 | | | — | — | — | — | — | — | K181 |
| 200 | | | — | — | — | — | — | — | K181 |
| 201 | | | — | — | — | — | — | — | K161 |
| 202 | | | — | — | — | — | — | — | K181 |
| 203 | | | — | — | — | — | — | — | K181 |
| 204 | | | — | — | — | — | — | — | K181 |
| 205 | | | — | — | — | — | — | — | K181 |
| 206 | | | — | — | — | — | — | — | K181 |
| 207 | | | — | — | — | — | — | — | K181 |
| 208 | | | — | — | — | — | — | — | K181 |
| 209 | | | — | — | — | — | — | — | K181 |
| 210 | | | — | — | — | — | — | — | K181 |
| 211 | | | — | — | — | — | — | — | K181 |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| 212 | | | — | — | — | — | — | — | K181 |
| 213 | | | — | — | — | — | — | — | K181 |
| 214 | | | — | — | — | — | — | — | K181 |
| 215 | | | — | — | — | — | — | — | K181 |
| 216 | | | — | — | — | — | — | — | K181 |
| 217 | | | — | — | — | — | — | — | K181 |
| 218 | | | — | — | — | — | — | — | K181 |
| 219 | | | — | — | — | — | — | — | K181 |
| 220 | | | — | — | — | — | — | — | K181 |
| 221 | | | — | — | — | — | — | — | K181 |
| 222 | | | — | — | — | — | — | — | K181 |
| 223 | | | — | — | — | — | — | — | K181 |
| 224 | | | — | — | — | — | — | — | K181 |
| 225 | | | — | — | — | — | — | — | K181 |
| 226 | | | — | — | — | — | — | — | K181 |
| 227 | | | — | — | — | — | — | — | K181 |
| 228 | | | — | — | — | — | — | — | K181 |
| 229 | | | — | — | — | — | — | — | K181 |
| 230 | | | — | — | — | — | — | — | — |
| 231 | | | — | — | — | — | — | — | K181 |
| 232 | | | — | — | — | — | — | — | K181 |
| 233 | | | — | — | — | — | — | — | K181 |
| 234 | | | — | — | — | — | — | — | K181 |
| 235 | | | — | — | — | — | — | — | K181 |
| 236 | | | — | — | — | — | — | — | K181 |
| 237 | | | — | — | — | — | — | — | K181 |
| 238 | | | — | — | — | — | — | — | — |
| 239 | | | — | — | — | — | — | — | K181 |
| 240 | | | — | — | — | — | — | — | K181 |
| 241 | | | — | — | — | — | — | — | K181 |
| 242 | | | — | — | — | — | — | — | K181 |
| 243 | | | — | — | — | — | — | — | K181 |
| 244 | | | — | — | — | — | — | — | K181 |
| 245 | | | — | — | — | — | — | — | K181 |
| 246 | | | — | — | — | — | — | — | K181 |
| 247 | | | — | — | — | — | — | — | K181 |
| 248 | | | — | — | — | — | — | — | K181 |
| 249 | | | — | — | — | — | — | — | K187 |
| 250 | | | — | — | — | — | — | — | K181 |
| 251 | | | — | — | — | — | — | — | K171 |
| 252 | | | — | — | — | — | — | — | K181 |
| 253 | | | — | — | — | — | — | — | K181 |
| 254 | | | — | — | — | — | — | — | K181 |
| 255 | | | — | — | — | — | — | — | K181 |
| 256 | | | — | — | — | — | — | — | K181 |
| 257 | | | — | — | — | — | — | — | K181 |
| 258 | | | — | — | — | — | — | — | K181 |
| 259 | | | — | — | — | — | — | — | K181 |
| 260 | | | — | — | — | — | — | — | K181 |
| 261 | | | — | — | — | — | — | — | K181 |
| 262 | | | — | — | — | — | — | — | K180 |
| 263 | | | — | — | — | — | — | — | K181 |
| 264 | | | — | — | — | — | — | — | I181 |
| 265 | | | — | — | — | — | — | — | K181 |
| 266 | | | — | — | — | — | — | — | K181 |
| 267 | | | — | — | — | — | — | — | I181 |
| 268 | | | — | — | — | — | — | — | K181 |
| 269 | | | — | — | — | — | — | — | K181 |
| 270 | | | — | — | — | — | — | — | K181 |
| 271 | | | — | — | — | — | — | — | K181 |
| 272 | | | — | — | — | — | — | — | K181 |
| 273 | | | — | — | — | — | — | — | K181 |
| 274 | | | — | — | — | — | — | — | K181 |
| 275 | | | P280 | — | — | — | — | A288 | — |
| 276 | | | P280 | — | — | — | — | A288 | — |
| 277 | | | P280 | — | — | — | — | A288 | — |
| 278 | | | P280 | — | — | — | — | A288 | — |
| 279 | | | P280 | — | — | — | — | A288 | — |
| 280 | | | P280 | — | — | — | — | A288 | S300 |
| 281 | | | P280 | — | — | — | — | A288 | — |
| 282 | | | P280 | — | — | — | — | A288 | — |
| 283 | | | P280 | — | — | — | — | A288 | — |
| 284 | | | P280 | — | — | — | — | A288 | — |
| 285 | | | P280 | — | — | — | — | A288 | — |
| 286 | | | P280 | — | — | — | — | A288 | — |
| 287 | | | P280 | — | — | — | — | A288 | L300 |
| 288 | | | P280 | — | — | — | — | A288 | — |
| 289 | | | P280 | — | — | — | — | A288 | — |

TABLE 2b-3-continued

| ID | Pos 41 | Pos 42 | Pos 43 | Pos 44 | Pos 45 | Pos 46 | Pos 47 | Pos 48 | Pos 49 |
|---|---|---|---|---|---|---|---|---|---|
| | | 290 | P280 | — | — | — | — | A288 | — |
| | | 291 | P280 | — | — | — | — | A288 | — |
| | | 292 | P283 | — | — | — | — | A291 | A304 |
| | | 293 | P281 | — | — | — | — | K289 | E302 |
| | | 294 | P283 | — | — | — | — | R291 | — |
| | | 295 | P282 | — | — | — | — | L290 | — |
| | | 296 | P282 | — | — | — | — | R290 | — |
| | | 297 | P282 | — | — | — | — | R290 | — |
| | | 298 | P282 | — | — | — | — | L290 | — |
| | | 299 | P287 | — | — | — | — | K295 | A307 |
| | | 300 | P286 | — | — | — | — | K294 | — |
| | | 301 | P282 | — | — | — | — | R290 | A303 |

Assays to test for the functionality of such mutants are readily available in the art, and respectively, described in the Example section of the present invention.

In a preferred embodiment, the mutated PPO refers to a polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, in which the amino acid sequence differs at Mutated site 1 (which corresponds to Arg128 of SEQ ID NO: 1) according to Table 2a, and/or at Mutated site 5 (which corresponds to Phe420 of SEQ ID NO: 1) according to Table 2a.

Examples of differences at these amino acid positions include, but are not limited to, one or more of the following:

the amino acid at Mutated site 1 is other than Arginine (or Tryosine, or Cysteine; as the case may be according to Table 2a);

the amino acid at Mutated site 5 is other than Phenylalanine (or Methionine, or Tyrosine, or Leucine, as the case may be according to Table 2a).

In particularly preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 (which corresponds to Arg128 of SEQ ID NO: 1) is Leu, Ala, Val, Ile, Met, Tyr, Gly, Asn, Cys, Phe, Ser, Thr, Gln, or His, and the amino acid at Mutated site 5 (which corresponds to Phe420 of SEQ ID NO: 1) is Ala, Leu, Val, Ile, or Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Leu, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Leu, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Leu, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Leu, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Leu, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ala, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ala, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ala, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ala, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ala, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 1 is Val, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 1 is Val, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 1 is Val, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 1 is Val, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 1 is Val, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ile, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ile, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ile, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ile, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ile, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Met, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Met, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Met, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Met, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Met, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Tyr, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Tyr, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Tyr, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Tyr, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Tyr, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gly, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gly, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gly, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gly, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gly, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Asn, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Asn, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Asn, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Asn, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Asn, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Cys, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Cys, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Cys, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Cys, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Cys, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Phe, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Phe, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Phe, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Phe, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Phe, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ser, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ser, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ser, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ser, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Ser, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Thr, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Thr, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Thr, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Thr, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Thr, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gln, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gln, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gln, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gln, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is Gln, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is His, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 1 is His, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 1 is His, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 1 is His, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 1 is His, and the amino acid at Mutated site 5 is Met.

In another preferred embodiment, the mutated PPO refers to a polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, in which the amino acid sequence differs at Mutated site 4 (which corresponds to Leu397 of SEQ ID NO: 1) according to Table 2a, and/or at Mutated site 5 (which corresponds to Phe420 of SEQ ID NO: 1) according to Table 2a.

Examples of differences at these amino acid positions include, but are not limited to, one or more of the following:
the amino acid at Mutated site 4 is other than Leucine (or Alanine, or Serine, or Phenylalanine, as the case may be according to Table 2a);
the amino acid at Mutated site 5 is other than Phenylalanine (or Methionine, or Tyrosine, or Leucine, as the case may be according to Table 2a).

In particularly preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:
the amino acid at Mutated site 4 (which corresponds to Leu397 of SEQ ID NO: 1) is Ala, Arg, Val, Ile, Met, His, Lys, Asp, Glu, Ser, Thr, Asn, Gln, Cys, Gly, Pro, Phe, Tyr, or Trp, and the amino acid at Mutated site 5 (which corresponds to Phe420 of SEQ ID NO: 1) is Ala, Leu, Val, Ile, Met, His, Lys, Asp, Glu, Ser, Thr, Asn, Gln, Cys, Gly, Pro, Arg, Tyr, or Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 4 is Ala, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 4 is Ala, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 4 is Ala, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ala, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Arg, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Val, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ile, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which:

the amino acid at Mutated site 4 is Met, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Met, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is His, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Lys, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asp, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Glu, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Ser, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Thr, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Asn, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gln, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Cys, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Gly, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Pro, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Phe, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Tyr, and the amino acid at Mutated site 5 is Trp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Ala.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Leu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Val.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Ile.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Met.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is His.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Lys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Asp.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Glu.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Ser.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Thr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Asn.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Gln.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Cys.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Gly.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Pro.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Arg.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Tyr.

In another preferred embodiment, the mutated PPO comprises a sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, a variant, derivative, orthologue, paralogue or homologue thereof, in which: the amino acid at Mutated site 4 is Trp, and the amino acid at Mutated site 5 is Trp.

It will be within the knowledge of the skilled artisan to identify conserved regions and motifs shared between the homologues, orthologues and paralogues of PPO polypeptides comprising SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313. Having identified such conserved regions that may represent suitable binding motifs, amino acids corresponding to the amino acids listed in Table 2a and 2b can be chosen to be substituted by any other amino acid, preferably by the amino acids listed under mutated sites 1, 2, 3, 4, or 5.

In addition, the present invention refers to a method for identifying a PPO-inhibiting herbicide by using a wildtype or mutated PPO comprising the amino acid sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, or a variant or derivative thereof.

Said method comprises the steps of:

a) generating a transgenic cell or plant comprising a nucleic acid encoding a wildtype or mutated PPO, wherein the mutated PPO is expressed;

b) applying a PPO-inhibiting herbicide to the transgenic cell or plant of a) and to a control cell or plant of the same variety;

c) determining the growth or the viability of the transgenic cell or plant and the control cell or plant after application of said PPO-inhibiting herbicide, and d) selecting "PPO-inhibiting herbicides" which confer reduced growth to the control cell or plant as compared to the growth of the transgenic cell or plant.

By "control cell" or "similar, wild-type, plant, plant tissue, plant cell or host cell" is intended a plant, plant tissue, plant cell, or host cell, respectively, that lacks the herbicide-resistance characteristics and/or particular polynucleotide of the invention that are disclosed herein. The use of the term "wild-type" is not, therefore, intended to imply that a plant, plant tissue, plant cell, or other host cell lacks recombinant DNA in its genome, and/or does not possess herbicide-resistant characteristics that are different from those disclosed herein.

Another object refers to a method of identifying a nucleotide sequence encoding a mutated PPO which is resistant or tolerant to a PPO-inhibiting herbicide, the method comprising:

a) generating a library of mutated PPO-encoding nucleic acids, b) screening a population of the resulting mutated PPO-encoding nucleic acids by expressing each of said nucleic acids in a cell or plant and treating said cell or plant with a PPO-inhibiting herbicide, c) comparing the PPO-inhibiting herbicide-tolerance levels provided by said population of mutated PPO encoding nucleic acids with the PPO-inhibiting herbicide-tolerance level provided by a control PPO-encoding nucleic acid, d) selecting at least one mutated PPO-encoding nucleic acid that provides a significantly increased level of tolerance to a PPO-inhibiting herbicide as compared to that provided by the control PPO-encoding nucleic acid.

In a preferred embodiment, the mutated PPO-encoding nucleic acid selected in step d) provides at least 2-fold as much resistance or tolerance of a cell or plant to a PPO-inhibiting herbicide as compared to that provided by the control PPO-encoding nucleic acid.

In a further preferred embodiment, the mutated PPO-encoding nucleic acid selected in step d) provides at least 2-fold, at least 5-fold, at least 10-fold, at least 20-fold, at least 50-fold, at least 100-fold, at least 500-fold, as much resistance or tolerance of a cell or plant to a PPO-inhibiting herbicide as compared to that provided by the control PPO-encoding nucleic acid.

The resistance or tolerance can be determined by generating a transgenic plant or host cell, preferably a plant cell, comprising a nucleic acid sequence of the library of step a) and comparing said transgenic plant with a control plant or host cell, preferably a plant cell.

Another object refers to a method of identifying a plant or algae containing a nucleic acid comprising a nucleotide sequence encoding a wild-type or mutated PPO which is resistant or tolerant to a PPO-inhibiting herbicide, the method comprising:

a) identifying an effective amount of a PPO-inhibiting herbicide in a culture of plant cells or green algae that leads to death of said cells.

b) treating said plant cells or green algae with a mutagenizing agent, c) contacting said mutagenized cells population with an effective amount of PPO-inhibiting herbicide, identified in a), d) selecting at least one cell surviving these test conditions, e) PCR-amplification and sequencing of PPO genes from cells selected in d) and comparing such sequences to wild-type PPO gene sequences, respectively.

In a preferred embodiment, said mutagenizing agent is ethylmethanesulfonate (EMS). Many methods well known to the skilled artisan are available for obtaining suitable candidate nucleic acids for identifying a nucleotide sequence encoding a mutated PPO from a variety of different potential source organisms including microbes, plants, fungi, algae, mixed cultures etc. as well as environmental sources of DNA such as soil. These methods include inter alia the preparation of cDNA or genomic DNA libraries, the use of suitably degenerate oligonucleotide primers, the use of probes based upon known sequences or complementation assays (for example, for growth upon tyrosine) as well as the use of mutagenesis and shuffling in order to provide recombined or shuffled mutated PPO-encoding sequences.

Nucleic acids comprising candidate and control PPO encoding sequences can be expressed in yeast, in a bacterial host strain, in an alga or in a higher plant such as tobacco or *Arabidopsis* and the relative levels of inherent tolerance of the PPO encoding sequences screened according to a visible indicator phenotype of the transformed strain or plant in the presence of different concentrations of the selected PPO-inhibiting herbicide. Dose responses and relative shifts in dose responses associated with these indicator phenotypes (formation of brown color, growth inhibition, herbicidal effect etc) are conveniently expressed in terms, for example, of GR50 (concentration for 50% reduction of growth) or MIC (minimum inhibitory concentration) values where increases in values correspond to increases in inherent tolerance of the expressed PPO. For example, in a relatively rapid assay system based upon transformation of a bacterium such as *E. coli*, each mutated PPO encoding sequence may be expressed, for example, as a DNA sequence under expression control of a controllable promoter such as the lacZ promoter and taking suitable account, for example by the use of synthetic DNA, of such issues as codon usage in order to obtain as comparable a level of expression as possible of different PPO sequences. Such strains expressing nucleic acids comprising alternative candidate PPO sequences may be plated out on different concentrations of the selected PPO-inhibiting herbicide in, optionally, a tyrosine supplemented medium and the relative levels of inherent tolerance of the expressed PPO enzymes estimated on the basis of the extent and MIC for inhibition of the formation of the brown, ochronotic pigment.

In another embodiment, candidate nucleic acids are transformed into plant material to generate a transgenic plant, regenerated into morphologically normal fertile plants which are then measured for differential tolerance to selected PPO-inhibiting herbicides as described in the Example section hereinafter. Many suitable methods for transformation using suitable selection markers such as kanamycin, binary vectors such as from *Agrobacterium* and plant regeneration as, for example, from tobacco leaf discs are well known in the art. Optionally, a control population of plants is likewise transformed with a nucleic acid expressing the control PPO. Alternatively, an untransformed dicot plant such as *Arabidopsis* or Tobacco can be used as a control since this, in any case, expresses its own endogenous PPO. The average, and distribution, of herbicide tolerance levels of a range of primary plant transformation events or their progeny to PPO-inhibiting herbicides described supra are evaluated in the normal manner based upon plant damage, meristematic bleaching symptoms etc. at a range of different concentrations of herbicides. These data can be expressed in terms of, for example, GR50 values derived from dose/response curves having "dose" plotted on the x-axis and "percentage kill", "herbicidal effect", "numbers of emerging green plants" etc. plotted on the y-axis where increased GR50 values correspond to increased levels of inherent tolerance of the expressed PPO. Herbicides can suitably be applied pre-emergence or post-emergence.

Another object of the present invention refers to an isolated and/or recombinant and/or chemically synthesized nucleic acid encoding a mutated PPO comprising an amino acid sequence of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313 or a variant or derivative thereof.

In one embodiment, the nucleic acid is identifiable by a method as defined above.

In a preferred embodiment, the encoded mutated PPO is a variant of SEQ ID NO: 1, 11, 30, 31, 37, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, or an orthologue thereof, which includes one or more of the following:

the amino acid corresponding to Mutated site 1 is Leu, Ala, Val, Ile, Met, Tyr, Gly, Asn, Cys, Phe, Ser, Thr, Gln, or His; and/or the amino acid at or corresponding to Mutated site 4 is Ala, Arg, Val, Ile, Met, His, Lys, Asp, Glu, Ser, Thr, Asn, Gln, Cys, Gly, Pro, Phe, Tyr, or Trp, and/or and the amino acid at Mutated site 5 is Ala, Leu, Val, Ile, Met, His, Lys, Asp, Glu, Ser, Thr, Asn, Gln, Cys, Gly, Pro, Arg, Tyr, or Trp.

In another embodiment, the invention refers to a plant cell transformed by a nucleic acid encoding a mutated PPO polypeptide according to the present invention or to a plant cell which has been mutated to obtain a plant expressing a nucleic acid encoding a mutated PPO polypeptide according to the present invention, wherein expression of the nucleic acid in the plant cell results in increased resistance or tolerance to a PPO-inhibiting herbicide as compared to a wild type variety of the plant cell. Preferably, the mutated PPO polypeptide encoding nucleic acid comprises a) a polynucleotide encoding a polypeptide as shown in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202,203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, or a variant or derivative thereof; b) a polynucleotide comprising at least 60 consecutive nucleotides of any of a); and c) a polynucleotide complementary to the polynucleotide of any of a) through b).

The term "expression/expressing" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

To obtain the desired effect, i.e. plants that are tolerant or resistant to the PPO-inhibiting herbicide derivative herbicide of the present invention, it will be understood that the at least one nucleic acid is "over-expressed" by methods and means known to the person skilled in the art. The term "increased expression" or "overexpression" as used herein means any form of expression that is additional to the original wild-type expression level. Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, Freeling and Walbot, Eds., Springer, N.Y. (1994)

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen Genet 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the agrobacteria to act on plant seeds or to inoculate the plant meristem with agrobacteria. It has proved particularly expedient in accordance with the invention to allow a suspension of transformed agrobacteria to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). Agrobacteria transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with agrobacteria and seeds are obtained from the developing plants of which a certain proportion is transformed and thus transgenic [Feldman, K A and Marks M D (1987). Mol Gen Genet 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal of the inflorescences and incubation of the excision site in the center of the rosette with transformed agrobacteria, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, Si and Bent AF (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229). The genetically modified plant cells can be regenerated via all methods with which the skilled worker is familiar. Suitable methods can be found in the abovementioned publications by S. D. Kung and R. Wu, Potrykus or Hofgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

Preferably, the wild-type or mutated PPO nucleic acid comprises a polynucleotide sequence selected from the group consisting of: a) a polynucleotide encoding a polypeptide as shown in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, or a variant or derivative thereof; b) a polynucleotide comprising at least 60 consecutive nucleotides of any of a); and c) a polynucleotide complementary to the polynucleotide of any of a) through b).

Preferably, the expression of the nucleic acid in the plant results in the plant's increased resistance to PPO-inhibiting herbicide as compared to a wild type variety of the plant.

In another embodiment, the invention refers to a plant, preferably a transgenic plant, comprising a plant cell according to the present invention, wherein expression of the nucleic acid in the plant results in the plant's increased resistance to PPO-inhibiting herbicide as compared to a wild type variety of the plant.

The plants described herein can be either transgenic crop plants or non-transgenic plants.

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or (b) genetic control sequence(s) which is operably linked with the nucleic acid sequence according to the invention, for example a promoter, or (c) a) and b)

are not located in their natural genetic environment or have been modified by recombinant methods, it being possible for the modification to take the form of, for example, a substitution, addition, deletion, inversion or insertion of one or more nucleotide residues in order to allow for the expression of the mutated PPO of the present invention. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place.

Preferred transgenic plants are mentioned herein. Furthermore, the term "transgenic" refers to any plant, plant cell, callus, plant tissue, or plant part, that contains all or part of at least one recombinant polynucleotide. In many cases, all or part of the recombinant polynucleotide is stably integrated into a chromosome or stable extra-chromosomal element, so that it is passed on to successive generations. For the purposes of the invention, the term "recombinant polynucleotide" refers to a polynucleotide that has been altered, rearranged, or modified by genetic engineering. Examples include any cloned polynucleotide, or polynucleotides, that are linked or joined to heterologous sequences. The term "recombinant" does not refer to alterations of polynucleotides that result from naturally occurring events, such as spontaneous mutations, or from non-spontaneous mutagenesis followed by selective breeding.

Plants containing mutations arising due to non-spontaneous mutagenesis and selective breeding are referred to herein as non-transgenic plants and are included in the present invention. In embodiments wherein the plant is transgenic and comprises multiple mutated PPO nucleic acids, the nucleic acids can be derived from different genomes or from the same genome. Alternatively, in embodiments wherein the plant is non-transgenic and comprises multiple mutated PPO nucleic acids, the nucleic acids are located on different genomes or on the same genome. As used herein, "mutagenized" refers to an organism or DNA thereof having alteration(s) in the biomolecular sequence of its native genetic material as compared to the sequence of the genetic material of a corresponding wild-type organism or DNA, wherein the alteration(s) in genetic material were induce and/or selected by human action. Methods of inducing mutations can induce mutations in random positions in the genetic material or can induce mutations in specific locations in the genetic material (i.e., can be directed mutagenesis techniques), such as by use of a genoplasty technique.

In certain embodiments, the present invention involves herbicide-resistant plants that are produced by mutation breeding. Such plants comprise a polynucleotide encoding a mutated PPO and are tolerant to one or more PPO-inhibiting herbicides. Such methods can involve, for example, exposing the plants or seeds to a mutagen, particularly a chemical mutagen such as, for example, ethyl methanesulfonate (EMS) and selecting for plants that have enhanced tolerance to at least one or more PPO-inhibiting herbicide.

However, the present invention is not limited to herbicide-tolerant plants that are produced by a mutagenesis method involving the chemical mutagen EMS. Any mutagenesis method known in the art may be used to produce the herbicide-resistant plants of the present invention. Such mutagenesis methods can involve, for example, the use of any one or more of the following mutagens: radiation, such as X-rays, Gamma rays (e.g., cobalt 60 or cesium 137), neutrons, (e.g., product of nuclear fission by uranium 235 in an atomic reactor), Beta radiation (e.g., emitted from radioisotopes such as phosphorus 32 or carbon 14), and ultraviolet radiation (preferably from 2500 to 2900 nm), and chemical mutagens such as base analogues (e.g., 5-bromo-uracil), related compounds (e.g., 8-ethoxy caffeine), antibiotics (e.g., streptonigrin), alkylating agents (e.g., sulfur mustards, nitrogen mustards, epoxides, ethylenamines, sulfates, sulfonates, sulfones, lactones), azide, hydroxylamine, nitrous acid, or acridines. Herbicide-resistant plants can also be produced by using tissue culture methods to select for plant cells comprising herbicide-resistance mutations and then regenerating herbicide-resistant plants therefrom. See, for example, U.S. Pat. Nos. 5,773,702 and 5,859,348, both of which are herein incorporated in their entirety by reference. Further details of mutation breeding can be found in "Principals of Cultivar Development" Fehr, 1993 Macmillan Publishing Company the disclosure of which is incorporated herein by reference In addition to the definition above, the term "plant" is intended to encompass crop plants at any stage of maturity or development, as well as any tissues or organs (plant parts) taken or derived from any such plant unless otherwise clearly indicated by context. Plant parts include, but are not limited to, stems, roots, flowers, ovules, stamens, leaves, embryos, meristematic regions, callus tissue, anther cultures, gametophytes, sporophytes, pollen, microspores, protoplasts, and the like.

The plant of the present invention comprises at least one mutated PPO nucleic acid or over-expressed wild-type PPO nucleic acid, and has increased tolerance to a PPO-inhibiting herbicide as compared to a wild-type variety of the plant. It is possible for the plants of the present invention to have multiple wild-type or mutated PPO nucleic acids from different genomes since these plants can contain more than one genome. For example, a plant contains two genomes, usually referred to as the A and B genomes. Because PPO is a required metabolic enzyme, it is assumed that each genome has at least one gene coding for the PPO enzyme (i.e. at least one PPO gene). As used herein, the term "PPO gene locus" refers to the position of an PPO gene on a genome, and the terms "PPO gene" and "PPO nucleic acid" refer to a nucleic acid encoding the PPO enzyme. The PPO nucleic acid on each genome differs in its nucleotide sequence from an PPO nucleic acid on another genome. One of skill in the art can determine the genome of origin of each PPO nucleic acid through genetic crossing and/or either sequencing methods or exonuclease digestion methods known to those of skill in the art.

The present invention includes plants comprising one, two, three, or more mutated PPO alleles, wherein the plant has increased tolerance to a PPO-inhibiting herbicide as compared to a wild-type variety of the plant. The mutated PPO alleles can comprise a nucleotide sequence selected from the group consisting of a polynucleotide encoding a polypeptide as defined in SEQ ID NO:
1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, or a variant or derivative, homologue, orthologue, paralogue thereof, a polynucleotide comprising at least 60 consecutive nucleotides of any of the aforementioned polynucleotides; and a polynucleotide complementary to any of the aforementioned polynucleotides.

"Alleles" or "allelic variants" are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms The term "variety" refers to a group of plants within a species defined by the sharing of a common set of characteristics or traits accepted by those skilled in the art as sufficient to distinguish one cultivar or variety from another cultivar or variety. There is no implication in either term that all plants of any given cultivar or variety will be genetically identical at either the whole gene or molecular level or that any given plant will be homozygous at all loci. A cultivar or variety is considered "true breeding" for a particular trait if, when the true-breeding cultivar or variety is self-pollinated, all of the progeny contain the trait. The terms "breeding line" or "line" refer to a group of plants within a cultivar defined by the sharing of a common set of characteristics or traits accepted by those skilled in the art as sufficient to distinguish one breeding line or line from another breeding line or line. There is no implication in either term that all plants of any given breeding line or line will be genetically identical at either the whole gene or molecular level or that any given plant will be homozygous at all loci. A breeding line or line is considered "true breeding" for a particular trait if, when the true-breeding line or breeding line is self-pollinated, all of the progeny contain the trait. In the present invention, the trait arises from a mutation in a PPO gene of the plant or seed.

In some embodiments, traditional plant breeding is employed whereby the PPO-inhibiting herbicides-tolerant trait is introduced in the progeny plant resulting therefrom. In one embodiment, the present invention provides a method for producing a PPO-inhibiting herbicides-tolerant progeny plant, the method comprising: crossing a parent plant with a PPO-inhibiting herbicides-tolerant plant to introduce the PPO-inhibiting herbicides-tolerance characteristics of the PPO-inhibiting herbicides-tolerant plant into the germplasm of the progeny plant, wherein the progeny plant has increased tolerance to the PPO-inhibiting herbicides relative to the parent plant. In other embodiments, the method further comprises the step of introgressing the PPO-inhibiting herbicides-tolerance characteristics through traditional plant breeding techniques to obtain a descendent plant having the PPO-inhibiting herbicides-tolerance characteristics.

The herbicide-resistant plants of the invention that comprise polynucleotides encoding mutated PPO polypeptides also find use in methods for increasing the herbicide-resistance of a plant through conventional plant breeding involving sexual reproduction. The methods comprise crossing a first plant that is a herbicide-resistant plant of the invention to a second plant that may or may not be resistant to the same herbicide or herbicides as the first plant or may be resistant to different herbicide or herbicides than the first plant. The second plant can be any plant that is capable of producing viable progeny plants (i.e., seeds) when crossed with the first plant. Typically, but not necessarily, the first and second plants are of the same species. The methods can optionally involve selecting for progeny plants that comprise the mutated PPO polypeptides of the first plant and the herbicide resistance characteristics of the second plant. The progeny plants produced by this method of the present invention have increased resistance to a herbicide when compared to either the first or second plant or both. When the first and second plants are resistant to different herbicides, the progeny plants will have the combined herbicide tolerance characteristics of the first and second plants. The methods of the invention can further involve one or more generations of backcrossing the progeny plants of the first cross to a plant of the same line or genotype as either the first or second plant. Alternatively, the progeny of the first cross or any subsequent cross can be crossed to a third plant that is of a different line or genotype than either the first or second plant. The present invention also provides plants, plant organs, plant tissues, plant cells, seeds, and non-human host cells that are transformed with the at least one polynucleotide molecule, expression cassette, or transformation vector of the invention. Such transformed plants, plant organs, plant tissues, plant cells, seeds, and non-human host cells have enhanced tolerance or resistance to at least one herbicide, at levels of the herbicide that kill or inhibit the growth of an untransformed plant, plant tissue, plant cell, or non-human host cell, respectively. Preferably, the transformed plants, plant tissues, plant cells, and seeds of the invention are *Arabidopsis thaliana* and crop plants.

In other aspects, plants of the invention include those plants which, in addition to being tolerant to PPO-inhibiting herbicides, have been subjected to further genetic modifications by breeding, mutagenesis or genetic engineering, e.g. have been rendered tolerant to applications of specific other classes of herbicides, such as AHAS inhibitors; auxinic herbicides; bleaching herbicides such as hydroxyphenylpyruvate dioxygenase (HPPD) inhibitors or phytoene desaturase (PDS) inhibitors; EPSPS inhibitors such as glyphosate; glutamine synthetase (GS) inhibitors such as glufosinate; lipid biosynthesis inhibitors such as acetyl CoA carboxylase (ACCase) inhibitors; or oxynil {i.e. bromoxynil or ioxynil) herbicides as a result of conventional methods of breeding or genetic engineering, Thus, PPO-inhibiting herbicides-tolerant plants of the invention can be made resistant to multiple classes of herbicides through multiple genetic modifications, such as resistance to both glyphosate and glufosinate or to both glyphosate and a herbicide from another class such as HPPD inhibitors, AHAS inhibitors, or ACCase inhibitors. These herbicide resistance technologies are, for example, described in Pest Management Science (at volume, year, page): 61, 2005, 246; 61, 2005, 258; 61, 2005, 277; 61, 2005, 269; 61, 2005, 286; 64, 2008, 326; 64, 2008, 332; Weed Science 57, 2009, 108; Australian Journal of Agricultural Research 58, 2007, 708; Science 316, 2007, 1185; and references quoted therein. For example, PPO-inhibiting herbicides-tolerant plants of the invention, in some embodiments, may be tolerant to ACCase inhibitors, such as “dims” {e.g., cycloxydim, sethoxydim, clethodim, or tepraloxydim), “fops” {e.g; clodinafop, diclofop, fluazifop, haloxyfop, or quizalofop), and “dens” (such as pinoxaden); to auxinic herbicides, such as dicamba; to EPSPS inhibitors, such as glyphosate; to other PPO inhibitors; and to GS inhibitors, such as glufosinate.

In addition to these classes of inhibitors, PPO-inhibiting herbicides-tolerant plants of the invention may also be tolerant to herbicides having other modes of action, for example, chlorophyll/carotenoid pigment inhibitors, cell membrane disrupters, photosynthesis inhibitors, cell division inhibitors, root inhibitors, shoot inhibitors, and combinations thereof.

Such tolerance traits may be expressed, e.g.: as mutant or wildtype PPO proteins, as mutant AHASL proteins, mutant ACCase proteins, mutant EPSPS proteins, or mutant glutamine synthetase proteins; or as mutant native, inbred, or transgenic aryloxyalkanoate dioxygenase (AAD or DHT), haloarylnitrilase (BXN), 2,2-dichloropropionic acid dehalogenase (DEH), glyphosate-N-acetyltransferase (GAT), glyphosate decarboxylase (GDC), glyphosate oxidoreductase (GOX), glutathione-S-transferase (GST), phosphinothricin acetyltransferase (PAT or bar), or CYP450s proteins having an herbicide-degrading activity.

PPO-inhibiting herbicides-tolerant plants hereof can also be stacked with other traits including, but not limited to, pesticidal traits such as Bt Cry and other proteins having pesticidal activity toward coleopteran, lepidopteran, nematode, or other pests; nutrition or nutraceutical traits such as modified oil content or oil profile traits, high protein or high amino acid concentration traits, and other trait types known in the art.

Furthermore, in other embodiments, PPO-inhibiting herbicides-tolerant plants are also covered which are, by the use of recombinant DNA techniques and/or by breeding and/or otherwise selected for such characteristics, rendered able to synthesize one or more insecticidal proteins, especially those known from the bacterial genus *Bacillus*, particularly from *Bacillus thuringiensis*, such as [delta]-endotoxins, e.g. CryIA(b), CryIA(c), CryIF, CryIF(a2), CryIIA(b), CryIIIA, CryIIIB(b1) or Cry9c; vegetative insecticidal proteins (VIP), e.g. VIP1, VIP2, VIP3 or VIP3A; insecticidal proteins of bacteria colonizing nematodes, e.g. *Photorhabdus* spp. or Xenorhabdus spp.; toxins produced by animals, such as scorpion toxins, arachnid toxins, wasp toxins, or other insect-specific neurotoxins; toxins produced by fungi, such streptomycete toxins; plant lectins, such as pea or barley lectins; agglutinins; proteinase inhibitors, such as trypsin inhibitors, serine protease inhibitors, patatin, cystatin or papain inhibitors; ribosome-inactivating proteins (RIP), such as ricin, maize-RIP, abrin, luffin, saporin or bryodin; steroid metabolism enzymes, such as 3-hydroxy-steroid oxidase, ecdysteroid-IDP-glycosyl-transferase, cholesterol oxidases, ecdysone inhibitors or HMG- CoA-reductase; ion channel blockers, such as blockers of sodium or calcium channels; juvenile hormone esterase; diuretic hormone receptors (helicokinin receptors); stilben synthase, bibenzyl synthase, chitinases or glucanases. In the context of the present invention these insecticidal proteins or toxins are to be understood expressly also as pre-toxins, hybrid proteins, truncated or otherwise modified proteins. Hybrid proteins are characterized by a new combination of protein domains, (see, e.g. WO 02/015701). Further examples of such toxins or genetically modified plants capable of synthesizing such toxins are disclosed, e.g., in EP-A 374 753, WO 93/007278, WO 95/34656, EP-A 427 529, EP-A 451 878, WO 03/18810 and WO 03/52073. The methods for producing such genetically modified plants are generally known to the person skilled in the art and are described, e.g. in the publications mentioned above. These insecticidal proteins contained in the genetically modified plants impart to the plants producing these proteins tolerance to harmful pests from all taxonomic groups of arthropods, especially to beetles (Coeloptera), two-winged insects (Diptera), and moths (Lepidoptera) and to nematodes (Nematoda).

In some embodiments, expression of one or more protein toxins (e.g., insecticidal proteins) in the PPO-inhibiting herbicides-tolerant plants is effective for controlling organisms that include, for example, members of the classes and orders: Coleoptera such as the American bean weevil *Acanthoscelides obtectus*; the leaf beetle *Aqelastica alni*; click beetles (*Agriotes lineatus, Agriotes obscurus, Agriotes bicolor*); the grain beetle *Ahasverus advena*; the summer schafer *Amphimallon solstitialis*; the furniture beetle *Anobium punctatum; Anthonomus* spp. (weevils); the Pygmy mandold beetle *Atomaria linearis*; carpet beetles (*Anthrenus* spp., *Attagenus* spp.); the cowpea weevil *Callosobruchus maculates*; the fried fruit beetle *Carpophilus hemipterus*; the cabbage seedpod weevil *Ceutorhynchus assimilis*; the rape winter stem weevil *Ceutorhynchus picitarsis*; the wireworms *Conoderus vespertinus* and *Conoderus falli*; the banana weevil *Cosmopolites sordidus*; the New Zealand grass grub *Costelytra zealandica*; the June beetle *Cotinis nitida*; the sunflower stem weevil *Cylindrocopturus adspersus*; the larder beetle *Dermestes lardarius*; the corn rootworms *Diabrotica virgifera, Diabrotica virgifera virgifera*, and *Diabrotica barberi*; the Mexican bean beetle *Epilachna varivestis*; the old house borer *Hylotropes bajulus*; the lucerne weevil *Hypera postica*; the shiny spider beetle *Gibbium psylloides*; the cigarette beetle *Lasioderma serricorne*; the Colorado potato beetle *Leptinotarsa decemlineata; Lyctus* beetles {*Lyctus* spp., the pollen beetle *Meligethes aeneus*; the common cockshafer *Melolontha melolontha*; the American spider beetle *Mezium americanum*; the golden spider beetle *Niptus hololeucs*; the grain beetles *Oryzaephilus surinamensis* and *Oryzaephilus Mercator*; the black vine weevil *Otiorhynchus sulcatus*; the mustard beetle *Phaedon cochleariae*, the crucifer flea beetle *Phyllotreta cruciferae*; the striped flea beetle *Phyllotreta striolata*; the cabbage steam flea beetle *Psylliodes chrysocephala; Ptinus* spp. (spider beetles); the lesser grain borer *Rhizopertha dominica*; the pea and been weevil *Sitona lineatus*; the rice and granary beetles *Sitophilus oryzae* and *Sitophilus granaries*; the red sunflower seed weevil *Smicronyx fulvus*; the drugstore beetle *Stegobium paniceum*; the yellow mealworm beetle *Tenebrio molitor*, the flour beetles *Tribolium castaneum* and *Tribolium confusum*; warehouse and cabinet beetles {*Trogoderma* spp.); the sunflower beetle *Zygogramma* exclamation's; *Dermaptera* (earwigs) such as the European earwig *Forficula auricularia* and the striped earwig *Labidura riparia; Dictyoptera* such as the oriental cockroach *Blatta orientalis*; the greenhouse millipede *Oxidus gracilis*; the beet fly *Pegomyia betae*; the frit fly *Oscinella frit*; fruitflies (*Dacus* spp., *Drosophila* spp.); *Isoptera* (termites) including species from the familes Hodotermitidae, Kalotermitidae, Mastotermitidae, Rhinotermitidae, Serritermitidae, Termitidae, Termopsidae; the tarnished plant bug *Lygus lineolaris*; the black bean aphid *Aphis fabae*; the cotton or melon aphid *Aphis gossypii*; the green apple aphid *Aphis pomi*; the citrus spiny whitefly *Aleurocanthus spiniferus*; the sweet potato whitefly *Bemesia tabaci*; the cabbage aphid *Brevicoryne brassicae*; the pear psylla *Cacopsylla pyricola*; the currant aphid *Cryptomyzus* rib's; the grape phylloxera *Daktulosphaira vitifoliae*; the citrus psylla *Diaphorina citri*; the potato leafhopper *Empoasca fabae*; the bean leafhopper *Empoasca Solana*; the vine leafhopper *Empoasca vitis*; the woolly aphid *Eriosoma lanigerum*; the European fruit scale *Eulecanium corni*; the mealy plum aphid *Hyalopterus arundinis*; the small brown planthopper *Laodelphax striatellus*; the potato aphid *Macrosiphum euphorbiae*; the green peach aphid *Myzus persicae*; the green rice leafhopper *Nephotettix cinticeps*; the brown planthopper *Nilaparvata lugens*; the hop aphid *Phorodon humuli*; the bird-cherry aphid *Rhopalosiphum padi*; the grain aphid *Sitobion avenae*; Lepidoptera such as *Adoxophyes orana* (summer fruit tortrix moth); *Archips podana* (fruit tree tortrix moth); *Bucculatrix pyrivorella* (pear leafminer); *Bucculatrix thurberiella* (cotton leaf perforator); *Bupalus piniarius* (pine looper); *Carpocapsa pomonella* (codling moth); *Chilo suppressalis* (striped rice borer); *Choristoneura fumiferana* (eastern spruce budworm); *Cochylis hospes* (banded sunflower moth); *Diatraea grandiosella* (southwestern corn borer); *Eupoecilia ambiquella* (European grape berry moth); *Helicoverpa armigera* (cotton bollworm); *Helicoverpa zea* (cotton bollworm); *Heliothis vires cens* (tobacco budworm), *Homeosoma electellum* (sunflower moth); *Homona magnanima* (oriental tea tree tortrix moth); *Lithocolletis blancardella* (spotted tentiform leafminer); *Lymantria dispar* (gypsy moth); *Malacosoma neustria* (tent caterpillar); *Mamestra brassicae* (cabbage armyworm); *Mamestra confiqurata* (Bertha armyworm); *Operophtera brumata* (winter moth); *Ostrinia nubilalis* (European corn borer), *Panolis flammea* (pine beauty moth), *Phyllocnistis citrella* (citrus leafminer); *Pieris brassicae* (cabbage white butterfly); *Rachiplusia ni* (soybean looper); *Spodoptera exiqua* (beet armywonn); *Spodoptera littoralis* (cotton leafworm); *Sylepta derogata* (cotton leaf roller); *Trichoplusia ni* (cabbage looper); Orthoptera such as the common cricket *Acheta domesticus*, tree locusts (*Anacridium* spp.), the migratory locust *Locusta migratoria*, the twostriped grasshopper *Melanoplus bivittatus*, the differential grasshopper *Melanoplus* differentialis, the redlegged grasshopper *Melanoplus femurrubrum*, the migratory grasshopper *Melanoplus sanquinipes*, the northern mole cricket *Neocurtilla hexadectyla*, the red locust *Nomadacris septemfasciata*, the shortwinged mole cricket *Scapteriscus abbreviatus*, the southern mole cricket *Scapteriscus borellii*, the tawny mole cricket *Scapteriscus vicinus*, and the desert locust *Schistocerca gregaria*; Symphyla such as the garden symphylan *Scutigerella immaculata*; Thysanoptera such as the tobacco *thrips Frankliniella fusca*, the flower *thrips Frankliniella intonsa*, the western flower *thrips Frankliniella occidentalism* the cotton bud *thrips Frankliniella schultzei*, the banded greenhouse *thrips Hercinothrips femoralis*, the soybean *thrips Neohydatothrips variabilis*, Kelly's citrus *thrips Pezothrips kellyanus*, the avocado *thrips Scirtothrips perseae*, the melon *thrips Thrips palmi*, and the onion *thrips Thrips tabaci*; and the like, and combinations comprising one or more of the foregoing organisms.

In some embodiments, expression of one or more protein toxins (e.g., insecticidal proteins) in the PPO-inhibiting herbicides-tolerant plants is effective for controlling flea beetles, i.e. members of the flea beetle tribe of family Chrysomelidae, preferably against *Phyllotreta* spp., such as *Phyllotreta cruciferae* and/or *Phyllotreta triolata.* In other embodiments, expression of one or more protein toxins {e.g., insecticidal proteins) in the PPO-inhibiting herbicides-tolerant plants is effective for controlling cabbage seedpod weevil, the Bertha armyworm, *Lygus* bugs, or the diamondback moth.

Furthermore, in one embodiment, PPO-inhibiting herbicides-tolerant plants are also covered which are, e.g. by the use of recombinant DNA techniques and/or by breeding and/or otherwise selected for such traits, rendered able to synthesize one or more proteins to increase the resistance or tolerance of those plants to bacterial, viral or fungal pathogens. The methods for producing such genetically modified plants are generally known to the person skilled in the art.

Furthermore, in another embodiment, PPO-inhibiting herbicides-tolerant plants are also covered which are, e.g. by the use of recombinant DNA techniques and/or by breeding and/or otherwise selected for such traits, rendered able to synthesize one or more proteins to increase the productivity (e.g. oil content), tolerance to drought, salinity or other growth-limiting environmental factors or tolerance to pests and fungal, bacterial or viral pathogens of those plants.

Furthermore, in other embodiments, PPO-inhibiting herbicides-tolerant plants are also covered which are, e.g. by the use of recombinant DNA techniques and/or by breeding and/or otherwise selected for such traits, altered to contain a modified amount of one or more substances or new substances, for example, to improve human or animal nutrition, e.g. oil crops that produce health-promoting long-chain omega-3 fatty acids or unsaturated omega-9 fatty acids (e.g. Nexera(R) rape, Dow Agro Sciences, Canada).

Furthermore, in some embodiments, PPO-inhibiting herbicides-tolerant plants are also covered which are, e.g. by the use of recombinant DNA techniques and/or by breeding and/or otherwise selected for such traits, altered to contain increased amounts of vitamins and/or minerals, and/or improved profiles of nutraceutical compounds.

In one embodiment, PPO-inhibiting herbicides-tolerant plants of the present invention, relative to a wild-type plant, comprise an increased amount of, or an improved profile of, a compound selected from the group consisting of: glucosinolates (e.g., glucoraphanin (4-methylsulfinylbutyl-glucosinolate), sulforaphane, 3-indolylmethyl-glucosinolate (glucobrassicin), I-methoxy-3-indolylmethyl-glucosinolate (neoglucobrassicin)); phenolics (e.g., flavonoids (e.g., quercetin, kaempferol), hydroxycinnamoyl derivatives (e.g., 1,2,2'-trisinapoylgentiobiose, 1,2-diferuloylgentiobiose, I,2'-disinapoyl-2-feruloylgentiobiose, 3-0-caffeoyl-quinic (neochlorogenic acid)); and vitamins and minerals (e.g., vitamin C, vitamin E, carotene, folic acid, niacin, riboflavin, thiamine, calcium, iron, magnesium, potassium, selenium, and zinc).

In another embodiment, PPO-inhibiting herbicides-tolerant plants of the present invention, relative to a wild-type plant, comprise an increased amount of, or an improved profile of, a compound selected from the group consisting of: progoitrin; isothiocyanates; indoles (products of glucosinolate hydrolysis); glutathione; carotenoids such as beta-carotene, lycopene, and the xanthophyll carotenoids such as lutein and zeaxanthin; phenolics comprising the flavonoids such as the flavonols (e.g. quercetin, rutin), the flavans/tannins (such as the procyanidins comprising coumarin, proanthocyanidins, catechins, and anthocyanins); flavones; phytoestroqens such as coumestans, lignans, resveratrol, isoflavones e.g. qenistein, daidzein, and qlycitein; resorcyclic acid lactones; organosulphur compounds; phytosterols; terpenoids such as carnosol, rosmarinic acid, glycyrrhizin and saponins; chlorophyll; chlorphyllin, sugars, anthocyanins, and vanilla. In other embodiments, PPO-inhibiting herbicides-tolerant plants of the present invention, relative to a wild-type plant, comprise an increased amount of, or an improved profile of, a compound selected from the group consisting of: vincristine, vinblastine, taxanes (e.g., taxol (paclitaxel), baccatin III, 10-desacetylbaccatin III, 10-desacetyl taxol, xylosyl taxol, 7-epitaxol, 7-epibaccatin III, 10-desacetylcephalomannine, 7-epicephalomannine, taxotere, cephalomannine, xylosyl cephalomannine, taxagifine, 8-benxoyloxy taxagifine, 9-acetyloxy taxusin, 9-hydroxy taxusin, taiwanxam, taxane Ia, taxane Ib, taxane Ic, taxane Id, GMP paclitaxel, 9-dihydro 13-acetylbaccatin III, 10-desacetyl-7-epitaxol, tetrahydrocannabinol (THC), cannabidiol (CBD), genistein, diadzein, codeine, morphine, quinine, shikonin, ajmalacine, serpentine, and the like.

It is to be understood that the plant of the present invention can comprise a wild type PPO nucleic acid in addition to a mutated PPO nucleic acid. It is contemplated that the PPO-inhibiting herbicide tolerant lines may contain a mutation in only one of multiple PPO isoenzymes. Therefore, the present invention includes a plant comprising one or more mutated PPO nucleic acids in addition to one or more wild type PPO nucleic acids.

In another embodiment, the invention refers to a seed produced by a transgenic plant comprising a plant cell of the present invention, wherein the seed is true breeding for an increased resistance to a PPO-inhibiting herbicide as compared to a wild type variety of the seed.

In another embodiment, the invention refers to a method of producing a transgenic plant cell with an increased resistance to a PPO-inhibiting herbicide as compared to a wild type variety of the plant cell comprising, transforming the plant cell with an expression cassette comprising a mutated PPO nucleic acid.

In another embodiment, the invention refers to a method of producing a transgenic plant comprising, (a) transforming a plant cell with an expression cassette comprising a mutated PPO nucleic acid, and (b) generating a plant with an increased resistance to PPO-inhibiting herbicide from the plant cell.

Consequently, mutated PPO nucleic acids of the invention are provided in expression cassettes for expression in the plant of interest. The cassette will include regulatory sequences operably linked to a mutated PPO nucleic acid sequence of the invention. The term "regulatory element" as used herein refers to a polynucleotide that is capable of regulating the transcription of an operably linked polynucleotide. It includes, but not limited to, promoters, enhancers, introns, 5' UTRs, and 3' UTRs. By "operably linked" is intended a functional linkage between a promoter and a second sequence, wherein the promoter sequence initiates and mediates transcription of the DNA sequence corresponding to the second sequence. Generally, operably linked means that the nucleic acid sequences being linked are contiguous and, where necessary to join two protein coding regions, contiguous and in the same reading frame. The cassette may additionally contain at least one additional gene to be cotransformed into the organism. Alternatively, the additional gene(s) can be provided on multiple expression cassettes.

Such an expression cassette is provided with a plurality of restriction sites for insertion of the mutated PPO nucleic acid sequence to be under the transcriptional regulation of the regulatory regions. The expression cassette may additionally contain selectable marker genes.

The expression cassette of the present invention will include in the 5'-3' direction of transcription, a transcriptional and translational initiation region (i.e., a promoter), a mutated PPO encoding nucleic acid sequence of the invention, and a transcriptional and translational termination region (i.e., termination region) functional in plants. The promoter may be native or analogous, or foreign or heterologous, to the plant host and/or to the mutated PPO nucleic acid sequence of the invention. Additionally, the promoter may be the natural sequence or alternatively a synthetic sequence. Where the promoter is "foreign" or "heterologous" to the plant host, it is intended that the promoter is not found in the native plant into which the promoter is introduced. Where the promoter is "foreign" or "heterologous" to the mutated PPO nucleic acid sequence of the invention, it is intended that the promoter is not the native or naturally occurring promoter for the operably linked mutated PPO nucleic acid sequence of the invention. As used herein, a chimeric gene comprises a coding sequence operably linked to a transcription initiation region that is heterologous to the coding sequence.

While it may be preferable to express the mutated PPO nucleic acids of the invention using heterologous promoters, the native promoter sequences may be used. Such constructs would change expression levels of the mutated PPO protein in the plant or plant cell. Thus, the phenotype of the plant or plant cell is altered.

The termination region may be native with the transcriptional initiation region, may be native with the operably linked mutated PPO sequence of interest, may be native with the plant host, or may be derived from another source (i.e., foreign or heterologous to the promoter, the mutated PPO nucleic acid sequence of interest, the plant host, or any combination thereof). Convenient termination regions are available from the Ti-plasmid of *A. tumefaciens*, such as the octopine synthase and nopaline synthase termination regions. See also Guerineau et al. (1991) Mol. Gen. Genet. 262: 141-144; Proudfoot (1991) Cell 64:671-674; Sanfacon et al. (1991) Genes Dev. 5: 141-149; Mogen et al. (1990) Plant Cell 2: 1261-1272; Munroe et al. (1990) Gene 91: 151-158; Ballas t al. (1989) Nucleic Acids Res. 17:7891-7903; and Joshi et al. (1987) Nucleic Acid Res. 15:9627-9639. Where appropriate, the gene(s) may be optimized for increased expression in the transformed plant. That is, the genes can be synthesized using plant-preferred codons for improved expression. See, for example, Campbell and Gowri (1990) Plant Physiol. 92: 1-11 for a discussion of host-preferred codon usage. Methods are available in the art for synthesizing plant-preferred genes. See, for example, U.S. Pat. Nos. 5,380,831, and 5,436,391, and Murray et al. (1989) Nucleic Acids Res. 17:477-498, herein incorporated by reference.

Additional sequence modifications are known to enhance gene expression in a cellular host. These include elimination of sequences encoding spurious polyadenylation signals, exon-intron splice site signals, transposon-like repeats, and other such well-characterized sequences that may be deleterious to gene expression. The G-C content of the sequence may be adjusted to levels average for a given cellular host, as calculated by reference to known genes expressed in the host cell. When possible, the sequence is modified to avoid predicted hairpin secondary mRNA structures. Nucleotide sequences for enhancing gene expression can also be used in the plant expression vectors. These include the introns of the maize Adhl, intronl gene (Callis et al. Genes and Development 1: 1183-1200, 1987), and leader sequences, (W-sequence) from the Tobacco Mosaic virus (TMV), Maize Chlorotic Mottle Virus and Alfalfa Mosaic Virus (Gallie et al. Nucleic Acid Res. 15:8693-8711, 1987 and Skuzeski et al. Plant Mol. Biol. 15:65-79, 1990). The first intron from the shrunken-1 locus of maize, has been shown to increase expression of genes in chimeric gene constructs. U.S. Pat. Nos. 5,424,412 and 5,593,874 disclose the use of specific introns in gene expression constructs, and Gallie et al. (Plant Physiol. 106:929-939, 1994) also have shown that introns are useful for regulating gene expression on a tissue specific basis. To further enhance or to optimize mutated PPO gene expression, the plant expression vectors of the invention may also contain DNA sequences containing matrix attachment regions (MARs). Plant cells transformed with such modified expression systems, then, may exhibit overexpression or constitutive expression of a nucleotide sequence of the invention.

The expression cassettes of the present invention may additionally contain 5' leader sequences in the expression cassette construct. Such leader sequences can act to enhance translation. Translation leaders are known in the art and include: picornavirus leaders, for example, EMCV leader (Encephalomyocarditis 5' noncoding region) (Elroy-Stein et al. (1989) Proc. Natl. Acad. ScL USA 86:6126-6130); potyvirus leaders, for example, TEV leader (Tobacco Etch Virus) (Gallie et al. (1995) Gene 165(2):233-238), MDMV leader (Maize Dwarf Mosaic Virus) (Virology 154:9-20), and human immunoglobulin heavy-chain binding protein (BiP) (Macejak et al. (1991) Nature 353:90-94); untranslated leader from the coat protein mRNA of alfalfa mosaic virus (AMV RNA 4) (Jobling et al. (1987) Nature 325:622-625); tobacco mosaic virus leader (TMV) (Gallie et al. (1989) in Molecular Biology of RNA, ed. Cech (Liss, New York), pp. 237-256); and maize chlorotic mottle virus leader (MCMV) (Lommel et al. (1991) Virology 81:382-385). See also, Della-Cioppa et al. (1987) Plant Physiol. 84:965-968. Other methods known to enhance translation can also be utilized, for example, introns, and the like.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and trans versions, may be involved.

A number of promoters can be used in the practice of the invention. The promoters can be selected based on the desired outcome. The nucleic acids can be combined with constitutive, tissue-preferred, or other promoters for expression in plants. Such constitutive promoters include, for example, the core promoter of the Rsyn7 promoter and other constitutive promoters disclosed in WO 99/43838 and U.S. Pat. No. 6,072,050; the core CaMV 35S promoter (Odell et al. (1985) Nature 313:810-812); rice actin (McElroy et al. (1990) Plant Cell 2: 163-171); ubiquitin (Christensen et al. (1989) Plant Mol. Biol. 12:619-632 and Christensen et al. (1992) Plant Mol. Biol. 18:675-689); pEMU (Last et al. (1991) Theor. Appl. Genet. 81:581-588); MAS (Velten et al. (1984) EMBO J. 3:2723-2730); ALS promoter (U.S. Pat. No. 5,659,026), and the like. Other constitutive promoters include, for example, U.S. Pat. Nos. 5,608,149; 5,608,144; 5,604,121; 5,569,597; 5,466,785; 5,399,680; 5,268,463; 5,608,142; and 6,177,611.

Tissue-preferred promoters can be utilized to target enhanced mutated PPO expression within a particular plant tissue. Such tissue-preferred promoters include, but are not limited to, leaf-preferred promoters, root-preferred promoters, seed-preferred promoters, and stem-preferred promoters. Tissue-preferred promoters include Yamamoto et al. (1997) Plant J. 12(2):255-265; Kawamata et al. (1997) Plant Cell Physiol. 38(7):792-803; Hansen et al. (1997) Mol. Gen Genet. 254(3):337-343; Russell et al. (1997) Transgenic Res. 6(2): 157-168; Rinehart et al. (1996) Plant Physiol. 112(3): 1331-1341; Van Camp et al. (1996) Plant Physiol. 112(2):525-535; Canevascini et al. (1996) Plant Physiol. 112(2):513-524; Yamamoto et al. (1994) Plant Cell Physiol. 35(5):773-778; Lam (1994) Results Probl. Cell Differ. 20: 181-196; Orozco et al. (1993) Plant Mol Biol. 23(6): 1129-1138; Matsuoka e/[alpha]/. (1993) Proc Natl. Acad. Sci. USA 90(20):9586-9590; and Guevara-Garcia et al. (1993) Plant J. 4(3):495-505. Such promoters can be modified, if necessary, for weak expression. In one embodiment, the nucleic acids of interest are targeted to the chloroplast for expression. In this manner, where the nucleic acid of interest is not directly inserted into the chloroplast, the expression cassette will additionally contain a chloroplast-targeting sequence comprising a nucleotide sequence that encodes a chloroplast transit peptide to direct the gene product of interest to the chloroplasts. Such transit peptides are known in the art. With respect to chloroplast-targeting sequences, "operably linked" means that the nucleic acid sequence encoding a transit peptide (i.e., the chloroplast-targeting sequence) is linked to the mutated PPO nucleic acid of the invention such that the two sequences are contiguous and in the same reading frame. See, for example, Von Heijne et al.

(1991) Plant Mol. Biol. Rep. 9: 104-126; Clark et al. (1989) J. Biol. Chem. 264:17544-17550; Della-Cioppa et al. (1987) Plant Physiol. 84:965-968; Romer et al. (1993) Biochem. Biophys. Res. Commun. 196:1414-1421; and Shah et al. (1986) Science 233:478-481. While the mutated PPO proteins of the invention include a native chloroplast transit peptide, any chloroplast transit peptide known in the art can be fused to the amino acid sequence of a mature mutated PPO protein of the invention by operably linking a choloroplast-targeting sequence to the 5'-end of a nucleotide sequence encoding a mature mutated PPO protein of the invention. Chloroplast targeting sequences are known in the art and include the chloroplast small subunit of ribulose-1, 5-bisphosphate carboxylase (Rubisco) (de Castro Silva Filho et al. (1996) Plant Mol. Biol. 30:769-780; Schnell et al. (1991) J. Biol. Chem. 266(5):3335-3342); 5-(enolpyruvyl)shikimate-3-phosphate synthase (EPSPS) (Archer et al. (1990) J. Bioenerg. Biomemb. 22(6):789-810); tryptophan synthase (Zhao et al. (1995) J. Biol. Chem. 270(11):6081-6087); plastocyanin (Lawrence et al. (1997) J. Biol. Chem. 272(33):20357-20363); chorismate synthase (Schmidt et al. (1993) J. Biol. Chem. 268(36):27447-27457); and the light harvesting chlorophyll a/b binding protein (LHBP) (Lamppa et al. (1988) J. Biol. Chem. 263: 14996-14999). See also Von Heijne et al. (1991) Plant Mol. Biol. Rep. 9: 104-126; Clark et al. (1989) J. Biol. Chem. 264:17544-17550; Della-Cioppa et al. (1987) Plant Physiol. 84:965-968; Romer et al. (1993) Biochem. Biophys. Res. Commun. 196: 1414-1421; and Shah et al. (1986) Science 233:478-481.

Methods for transformation of chloroplasts are known in the art. See, for example, Svab et al. (1990) Proc. Natl. Acad. ScL USA 87:8526-8530; Svab and Maliga (1993) Proc. Natl. Acad. Sci. USA 90:913-917; Svab and Maliga (1993) EMBO J. 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) Proc. Natl. Acad. Sci. USA 91:7301-7305. The nucleic acids of interest to be targeted to the chloroplast may be optimized for expression in the chloroplast to account for differences in codon usage between the plant nucleus and this organelle. In this manner, the nucleic acids of interest may be synthesized using chloroplast-preferred codons. See, for example, U.S. Pat. No. 5,380,831, herein incorporated by reference.

In a preferred embodiment, the mutated PPO nucleic acid comprises a polynucleotide sequence selected from the group consisting of: a) a polynucleotide encoding a polypeptide as shown in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, or a variant or derivative thereof; b) a polynucleotide comprising at least 60 consecutive nucleotides of any of a); and c) a polynucleotide complementary to the polynucleotide of any of a) through b)

Preferably, the expression cassette of the present invention further comprises a transcription initiation regulatory region and a translation initiation regulatory region that are functional in the plant.

While the polynucleotides of the invention find use as selectable marker genes for plant transformation, the expression cassettes of the invention can include another selectable marker gene for the selection of transformed cells. Selectable marker genes, including those of the present invention, are utilized for the selection of transformed cells or tissues. Marker genes include, but are not limited to, genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). See generally, Yarranton (1992) Curr. Opin. Biotech. 3:506-511; Christophers on et al (1992) Proc. Natl. Acad. ScL USA 89:6314-6318; Yao et al. (1992) Cell 71:63-72; Reznikoff (1992) Mol Microbiol 6:2419-2422; Barkley et al (1980) in The Operon, pp. 177-220; Hu et al (1987) Cell 48:555-566; Brown et al (1987) Cell 49:603-612; Figge et al (1988) Cell 52:713-722; Deuschle et al (1989) Proc. Natl Acad. AcL USA 86:5400-5404; Fuerst et al (1989) Proc. Natl Acad. ScL USA 86:2549-2553; Deuschle et al (1990) Science 248:480-483; Gossen (1993) Ph.D. Thesis, University of Heidelberg; Reines et al (1993) Proc. Natl Acad. ScL USA 90: 1917-1921; Labow et al (1990) Mol Cell Biol 10:3343-3356; Zambretti et al (1992) Proc. Natl Acad. ScL USA 89:3952-3956; Bairn et al (1991) Proc. Natl Acad. ScL USA 88:5072-5076; Wyborski et al (1991) Nucleic Acids Res. 19:4647-4653; Hillenand-Wissman (1989) Topics Mol Struc. Biol 10: 143-162; Degenkolb et al (1991) Antimicrob. Agents Chemother. 35: 1591-1595; Kleinschnidt et al (1988) Biochemistry 27: 1094-1104; Bonin (1993) Ph.D. Thesis, University of Heidelberg; Gossen et al (1992) Proc. Natl Acad. ScL USA 89:5547-5551; Oliva et al (1992) Antimicrob. Agents Chemother. 36:913-919; Hlavka et al (1985) Handbook of Experimental Pharmacology, Vol. 78 (Springer-Verlag, Berlin); Gill et al (1988) Nature 334:721-724. Such disclosures are herein incorporated by reference. The above list of selectable marker genes is not meant to be limiting. Any selectable marker gene can be used in the present invention.

The invention further provides an isolated recombinant expression vector comprising the expression cassette containing a mutated PPO nucleic acid as described above, wherein expression of the vector in a host cell results in increased tolerance to a PPO-inhibiting herbicide as compared to a wild type variety of the host cell. As used herein, the term "vector" refers to a nucleic acid molecule capable of transporting another nucleic acid to which it has been linked. One type of vector is a "plasmid," which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors." In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses, and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of polypeptide desired, etc. The expression vectors of the invention can be introduced into host cells to thereby produce polypeptides or peptides, including fusion polypeptides or peptides, encoded by nucleic acids as described herein (e.g., mutated PPO polypeptides, fusion polypeptides, etc.).

In a preferred embodiment of the present invention, the mutated PPO polypeptides are expressed in plants and plants cells such as unicellular plant cells (such as algae) (See Falciatore et al., 1999, Marine Biotechnology 1(3):239-251 and references therein) and plant cells from higher plants (e.g., the spermatophytes, such as crop plants). A mutated PPO polynucleotide may be "introduced" into a plant cell by any means, including transfection, transformation or transduction, electroporation, particle bombardment, agroinfection, biolistics, and the like.

Suitable methods for transforming or transfecting host cells including plant cells can be found in Sambrook et al. (Molecular Cloning: A Laboratory Manual. 2nd, ed., Cold Spring Harbor Laboratory, Cold Spring Harbor Laboratory Press, Cold Spring Harbor, NY, 1989) and other laboratory manuals such as Methods in Molecular Biology, 1995, Vol. 44, *Agrobacterium* protocols, ed: Gartland and Davey, Humana Press, Totowa, New Jersey. As increased tolerance to PPO-inhibiting herbicides is a general trait wished to be inherited into a wide variety of plants like maize, wheat, rye, oat, triticale, rice, barley, soybean, peanut, cotton, rapeseed and canola, manihot, pepper, sunflower and *tagetes*, solanaceous plants like potato, tobacco, eggplant, and tomato, *Vicia* species, pea, alfalfa, bushy plants (coffee, cacao, tea), Salix species, trees (oil palm, coconut), perennial grasses, and forage crops, these crop plants are also preferred target plants for a genetic engineering as one further embodiment of the present invention. In a preferred embodiment, the plant is a crop plant. Forage crops include, but are not limited to, Wheatgrass, Canarygrass, Bromegrass, Wildrye Grass, Bluegrass, Orchardgrass, Alfalfa, Salfoin, Birdsfoot Trefoil, Alsike Clover, Red Clover, and Sweet Clover.

In one embodiment of the present invention, transfection of a mutated PPO polynucleotide into a plant is achieved by *Agrobacterium* mediated gene transfer. One transformation method known to those of skill in the art is the dipping of a flowering plant into an Agrobacteria solution, wherein the Agrobacteria contains the mutated PPO nucleic acid, followed by breeding of the transformed gametes. *Agrobacterium* mediated plant transformation can be performed using for example the GV3101 (pMP90) (Koncz and Schell, 1986, Mol. Gen. Genet. 204:383-396) or LBA4404 (Clontech) *Agrobacterium tumefaciens* strain. Transformation can be performed by standard transformation and regeneration techniques (Deblaere et al., 1994, Nucl. Acids. Res. 13:4777-4788; Gelvin, Stanton B. and Schilperoort, Robert A, Plant Molecular Biology Manual, 2nd Ed. —Dordrecht: Kluwer Academic Publ., 1995.—in Sect., Ringbuc Zentrale Signatur: BT11-P ISBN 0-7923-2731-4; Glick, Bernard R. and Thompson, John E., Methods in Plant Molecular Biology and Biotechnology, Boca Raton: CRC Press, 1993 360 S., ISBN 0-8493-5164-2). For example, rapeseed can be transformed via cotyledon or hypocotyl transformation (Moloney et al., 1989, Plant Cell Report 8:238-242; De Block et al., 1989, Plant Physiol. 91:694-701). Use of antibiotics for *Agrobacterium* and plant selection depends on the binary vector and the *Agrobacterium* strain used for transformation. Rapeseed selection is normally performed using kanamycin as selectable plant marker. *Agrobacterium* mediated gene transfer to flax can be performed using, for example, a technique described by Mlynarova et al., 1994, Plant Cell Report 13:282-285. Additionally, transformation of soybean can be performed using for example a technique described in European Patent No. 0424 047, U.S. Pat. No. 5,322,783, European Patent No. 0397 687, U.S. Pat. No. 5,376,543, or U.S. Pat. No. 5,169,770. Transformation of maize can be achieved by particle bombardment, polyethylene glycol mediated DNA uptake, or via the silicon carbide fiber technique. (See, for example, Freeling and Walbot "The maize handbook" Springer Verlag: New York (1993) ISBN 3-540-97826-7). A specific example of maize transformation is found in U.S. Pat. No. 5,990,387, and a specific example of wheat transformation can be found in PCT Application No. WO 93/07256.

According to the present invention, the introduced mutated PPO polynucleotide may be maintained in the plant cell stably if it is incorporated into a non-chromosomal autonomous replicon or integrated into the plant chromosomes. Alternatively, the introduced mutated PPO polynucleotide may be present on an extra-chromosomal non-replicating vector and be transiently expressed or transiently active. In one embodiment, a homologous recombinant microorganism can be created wherein the mutated PPO polynucleotide is integrated into a chromosome, a vector is prepared which contains at least a portion of an PPO gene into which a deletion, addition, or substitution has been introduced to thereby alter, e.g., functionally disrupt, the endogenous PPO gene and to create a mutated PPO gene. To create a point mutation via homologous recombination, DNA-RNA hybrids can be used in a technique known as chimeraplasty (Cole-Strauss et al., 1999, Nucleic Acids Research 27(5):1323-1330 and Kmiec, 1999, Gene therapy American Scientist 87(3):240-247). Other homologous recombination procedures in *Triticum* species are also well known in the art and are contemplated for use herein.

In the homologous recombination vector, the mutated PPO gene can be flanked at its 5' and 3' ends by an additional nucleic acid molecule of the PPO gene to allow for homologous recombination to occur between the exogenous mutated PPO gene carried by the vector and an endogenous PPO gene, in a microorganism or plant. The additional flanking PPO nucleic acid molecule is of sufficient length for successful homologous recombination with the endogenous gene. Typically, several hundreds of base pairs up to kilobases of flanking DNA (both at the 5' and 3' ends) are included in the vector (see e.g., Thomas, K. R., and Capecchi, M. R., 1987, Cell 51:503 for a description of homologous recombination vectors or Strepp et al., 1998, PNAS, 95(8):4368-4373 for cDNA based recombination in *Physcomitrella patens*). However, since the mutated PPO gene normally differs from the PPO gene at very few amino acids, a flanking sequence is not always necessary. The homologous recombination vector is introduced into a microorganism or plant cell (e.g., via polyethylene glycol mediated DNA), and cells in which the introduced mutated PPO gene has homologously recombined with the endogenous PPO gene are selected using art-known techniques.

In another embodiment, recombinant microorganisms can be produced that contain selected systems that allow for regulated expression of the introduced gene. For example, inclusion of a mutated PPO gene on a vector placing it under control of the lac operon permits expression of the mutated PPO gene only in the presence of IPTG. Such regulatory systems are well known in the art.

Another aspect of the invention pertains to host cells into which a recombinant expression vector of the invention has been introduced. The terms "host cell" and "recombinant host cell" are used interchangeably herein. It is understood that such terms refer not only to the particular subject cell but they also apply to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, a mutated PPO polynucleotide can be expressed in bacterial cells such as *C. glutamicum*, insect cells, fungal cells, or mammalian cells (such as Chinese hamster ovary cells (CHO) or COS cells), algae, ciliates, plant cells, fungi or other microorganisms like *C. glutamicum*. Other suitable host cells are known to those skilled in the art.

A host cell of the invention, such as a prokaryotic or eukaryotic host cell in culture, can be used to produce (i.e., express) a mutated PPO polynucleotide. Accordingly, the invention further provides methods for producing mutated PPO polypeptides using the host cells of the invention. In one embodiment, the method comprises culturing the host cell of invention (into which a recombinant expression vector encoding a mutated PPO polypeptide has been introduced, or into which genome has been introduced a gene encoding a wild-type or mutated PPO polypeptide) in a suitable medium until mutated PPO polypeptide is produced. In another embodiment, the method further comprises isolating mutated PPO polypeptides from the medium or the host cell. Another aspect of the invention pertains to isolated mutated PPO polypeptides, and biologically active portions thereof. An "isolated" or "purified" polypeptide or biologically active portion thereof is free of some of the cellular material when produced by recombinant DNA techniques, or chemical precursors or other chemicals when chemically synthesized. The language "substantially free of cellular material" includes preparations of mutated PPO polypeptide in which the polypeptide is separated from some of the cellular components of the cells in which it is naturally or recombinantly produced. In one embodiment, the language "substantially free of cellular material" includes preparations of a mutated PPO polypeptide having less than about 30% (by dry weight) of non-mutated PPO material (also referred to herein as a "contaminating polypeptide"), more preferably less than about 20% of non-mutated PPO material, still more preferably less than about 10% of non-mutated PPO material, and most preferably less than about 5% non-mutated PPO material.

When the mutated PPO polypeptide, or biologically active portion thereof, is recombinantly produced, it is also preferably substantially free of culture medium, i.e., culture medium represents less than about 20%, more preferably less than about 10%, and most preferably less than about 5% of the volume of the polypeptide preparation. The language "substantially free of chemical precursors or other chemicals" includes preparations of mutated PPO polypeptide in which the polypeptide is separated from chemical precursors or other chemicals that are involved in the synthesis of the polypeptide. In one embodiment, the language "substantially free of chemical precursors or other chemicals" includes preparations of a mutated PPO polypeptide having less than about 30% (by dry weight) of chemical precursors or non-mutated PPO chemicals, more preferably less than about 20% chemical precursors or non-mutated PPO chemicals, still more preferably less than about 10% chemical precursors or non-mutated PPO chemicals, and most preferably less than about 5% chemical precursors or non-mutated PPO chemicals. In preferred embodiments, isolated polypeptides, or biologically active portions thereof, lack contaminating polypeptides from the same organism from which the mutated PPO polypeptide is derived. Typically, such polypeptides are produced by recombinant expression of, for example, a mutated PPO polypeptide in plants other than, or in microorganisms such as *C. glutamicum*, ciliates, algae, or fungi.

In other aspects, a method for treating a plant of the present invention is provided.

In some embodiments, the method comprises contacting the plant with an agronomically acceptable composition.

In another aspect, the present invention provides a method for preparing a descendent seed. The method comprises planting a seed of or capable of producing a plant of the present invention. In one embodiment, the method further comprises growing a descendent plant from the seed; and harvesting a descendant seed from the descendent plant. In other embodiments, the method further comprises applying a PPO-inhibiting herbicides herbicidal composition to the descendent plant.

In another embodiment, the invention refers to harvestable parts of the transgenic plant according to the present invention. Preferably, the harvestable parts comprise the PPO nucleic add or PPO protein of the present invention. The harvestable parts may be seeds, roots, leaves and/or flowers, comprising the PPO nucleic acid or PPO protein or parts thereof. Preferred parts of soy plants are soy beans comprising the PPO nucleic acid or PPO protein.

In another embodiment, the invention refers to products derived from a plant according to the present invention, parts thereof or harvestable parts thereof. A preferred plant product is fodder seed meal, oil, or seed-treatment-coated seeds. Preferably, the meal and/or oil comprises the mutated PPO nucleic acids or PPO proteins of the present invention.

In another embodiment, the invention refers to a method for the production of a product, which method comprises a) growing the plants of invention Or obtainable by the methods of invention and b) producing said product from or by the plants of the invention and/or parts e.g. seeds, of these plants.

In a further embodiment the method comprises the a) growing the plants of the invention, b) removing the harvestable parts as defined above from the plants and c) producing said product from or by the harvestable parts of the invention.

The product may be produced at the site where the plant has been grown, the plants and/or parts thereof may be removed from the site where the plants have been grown to produce the product. Typically, the plant is grown, the desired harvestable parts are removed from the plant, if feasible in repeated cycles, and the product made from the harvestable parts of the plant. The step of growing the plant may be performed only once each time the methods of the invention is performed, while allowing repeated times the steps of product production e.g. by repeated removal of harvestable parts of the plants of the invention and if necessary further processing of these parts to arrive at the product. It is also possible that the step of growing the plants of the invention is repeated and plants or harvestable parts are stored until the production of the product is then performed once for the accumulated plants or plant parts. Also, the steps of growing the plants and producing the product may be performed with an overlap in time, even simultaneously to a large extend or sequentially. Generally the plants are grown for some time before the product is produced.

In one embodiment the products produced by said methods of the invention are plant products such as, but not limited to, a foodstuff, feedstuff, a food supplement, feed supplement, fiber, cosmetic and/or pharmaceutical. Foodstuffs are regarded as compositions used for nutrition and/or for supplementing nutrition. Animal feedstuffs and animal feed supplements, in particular, are regarded as foodstuffs.

In another embodiment the inventive methods for the production are used to make agricultural products such as, but not limited to, plant extracts, proteins, amino acids, carbohydrates, fats, oils, polymers, vitamins, and the like.

It is possible that a plant product consists of one or more agricultural products to a large extent.

As described above, the present invention teaches compositions and methods for increasing the PPO-inhibiting tolerance of a crop plant or seed as compared to a wild-type variety of the plant or seed. In a preferred embodiment, the PPO-inhibiting tolerance of a crop plant or seed is increased such that the plant or seed can withstand a PPO-inhibiting herbicide application of preferably approximately 1-1000 g ai $ha^{-1}$, more preferably 1-200 g ai $ha^{-1}$, even more preferably 5-150 g ai $ha^{-1}$, and most preferably 10-100 g ai $ha^{-1}$. As used herein, to "withstand" a PPO-inhibiting herbicide application means that the plant is either not killed or only moderately injured by such application. It will be understood by the person skilled in the art that the application rates may vary, depending on the environmental conditions such as temperature or humidity, and depending on the chosen kind of herbicide (active ingredient ai).

Furthermore, the present invention provides methods that involve the use of at least one PPO-inhibiting herbicide, optionally in combination with one or more herbicidal compounds B, and, optionally, a safener C, as described in detail supra.

In these methods, the PPO-inhibiting herbicide can be applied by any method known in the art including, but not limited to, seed treatment, soil treatment, and foliar treatment. Prior to application, the PPO-inhibiting herbicide can be converted into the customary formulations, for example solutions, emulsions, suspensions, dusts, powders, pastes and granules. The use form depends on the particular intended purpose; in each case, it should ensure a fine and even distribution of the compound according to the invention.

By providing plants having increased tolerance to PPO-inhibiting herbicide, a wide variety of formulations can be employed for protecting plants from weeds, so as to enhance plant growth and reduce competition for nutrients. A PPO-inhibiting herbicide can be used by itself for pre-emergence, post-emergence, pre-planting, and at-planting control of weeds in areas surrounding the crop plants described herein, or a PPO-inhibiting herbicide formulation can be used that contains other additives. The PPO-inhibiting herbicide can also be used as a seed treatment. Additives found in a PPO-inhibiting herbicide formulation include other herbicides, detergents, adjuvants, spreading agents, sticking agents, stabilizing agents, or the like. The PPO-inhibiting herbicide formulation can be a wet or dry preparation and can include, but is not limited to, flowable powders, emulsifiable concentrates, and liquid concentrates. The PPO-inhibiting herbicide and herbicide formulations can be applied in accordance with conventional methods, for example, by spraying, irrigation, dusting, or the like.

Suitable formulations are described in detail in PCT/EP2009/063387 and PCT/EP2009/063386, which are incorporated herein by reference.

It should also be understood that the foregoing relates to preferred embodiments of the present invention and that numerous changes may be made therein without departing from the scope of the invention. The invention is further illustrated by the following examples, which are not to be construed in any way as imposing limitations upon the scope thereof. On the contrary, it is to be clearly understood that resort may be had to various other embodiments, modifications, and equivalents thereof, which, after reading the description herein, may suggest themselves to those skilled in the art without departing from the spirit of the present invention and/or the scope of the appended claims.

EXAMPLES

Example 1: Site-Directed Mutagenesis PPO

All nucleic acid coding sequence and all single and double mutants encoding a polypeptide comprising SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, are synthesized and cloned by Geneart (Geneart A G, Regensburg, Germany). Rational design mutants are synthesized by Geneart. Random PPO gene libraries are synthesized by Geneart. Plasmids are isolated from *E. coli* TOP10 by performing a plasmid min preparation and confirmed by DNA sequencing.

Example 2: Expression and Purification of Recombinant Wildtype and Mutant PPO (Taken from: Franck E. Dayan, Pankaj R. Daga, Stephen O. Duke, Ryan M. Lee, Patrick J. Tranel, Robert J. Doerksen. Biochemical and structural consequences of a glycine deletion in the α-8 helix of protoporphyrinogen oxidase. Biochimica et Biophysica Acta 1804 (2010), 1548-56) Clones in pRSET vector are transformed into BL21 (DE3)-pLysS strain of *E. coli*. Cells are grown in 250 mL of LB with 100 μgmL-1 of carbenicillin, shaking overnight at 37° C. Cultures are diluted in 1 L of LB with antibiotic and grown at 37° C. shaking for 2 h, induced with 1 mM IPTG and grown at 25° C. shaking for 5 more hours. The cells are harvested by centrifugation at 1600×g, washed with 0.09% NaCl, and stored at −80° C. Cells are lysed using a French press at 140 MPa in 50 mM sodium phosphate pH 7.5, 1 M NaCl, 5 mM imidazole, 5% glycerol, and 1 μg mL-1 leupeptin. Following lysis, 0.5 U of benzonase (Novagen, EMD Chemicals, Inc., Gibbstown, NJ) and PMSF (final concentration of 1 mM) are added. Cell debris is removed by centrifugation at 3000×g. His-tagged PPO proteins are purified on a nickel activated Hitrap Chelating HP column (GE Healthcare Bio-Sciences Corp., Piscataway, NJ) equilibrated with 20 mM sodium phosphate pH 8.0, 50 mM NaCl, 5 mM imidazole, 5 mM MgCl2, 0.1 mM EDTA, and 17% glycerol. PPO is eluted with 250 mM imidazole. The active protein is desalted on a PD-10 column (GE Healthcare Bio-Sciences Corp., Piscataway, NJ) equilibrated with a 20 mM sodium phosphate buffer, pH 7.5, 5 mM MgCl2, 1 mM EDTA and 17% glycerol. Each litre of culture provided approximately 10 mg of pure PPO, which is stored at −20° C. until being used in assays.

Example 3: PPO Enzyme Assay (Non-Recombinant)

PPO protein (EC 1.3.3.4) is extracted from coleoptiles or shoots (150 g fresh weight) of dark-grown corn, black nightshade, morning glory, and velvetleaf seedlings as described previously (Grossmann et al. 2010). Before harvesting, the seedlings are allowed to green for 2 hours in the light in order to achieve the highest specific enzyme activities in the thylakoid fractions at low chlorophyll concentrations. At high chlorophyll concentrations significant quenching of fluorescence occurs, which limits the amount of green thylakoids that can be used in the test. Plant materials are homogenized in the cold with a Braun blender using a fresh-weight-to-volume ratio of 1:4. Homogenization buffer consisted of tris(hydroxymethyl)aminomethane (Tris)-HCl (50 mM; pH 7.3), sucrose (0.5 M), magnesium chloride (1 mM), ethylenediaminetetraacetic acid (EDTA) (1 mM) and bovine serum albumin (2 g $L^{-1}$). After filtration through four layers of Miracloth, crude plastid preparations are obtained after centrifugation at 10 000×g for 5 min and resuspension in homogenization buffer before centrifugation at 150×g for 2 min to remove crude cell debris. The supernatant is centrifuged at 4000×g for 15 min and the pellet fraction is resuspended in 1 ml of a buffer containing Tris-HCl (50 mM; pH 7.3), EDTA (2 mM), leupeptin (2 μM), pepstatin (2 μM) and glycerol (200 ml $L^{-1}$) and stored at −80° C. until use. Protein is determined in the enzyme extract with bovine serum albumin as a standard. PPO activity is assayed fluorometrically by monitoring the rate of Proto formation from chemically reduced protoporphyrinogen IX under initial velocity conditions. The assay mixture consisted of Tris-HCl (100 mM; pH 7.3), EDTA (1 mM), dithiothreitol (5 mM), Tween 80 (0.085%), protoporphyrinogen IX (2 μM), and 40 μg extracted protein in a total volume of 200 μl. The reaction is initiated by addition of substrate protoporphyrinogen IX at 22° C. saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control are prepared in dimethyl sulfoxide (DMSO) solution (0.1 mM concentration of DMSO in the assay) and added to the assay mixture in concentrations of 0.005 μM to 5 μM before incubation. Fluorescence is monitored directly from the assay mixture using a POLARstar Optima/Galaxy (BMG) with excitation at 405 nm and emission monitored at 630 nm. Non-enzymatic activity in the presence of heat-inactivated extract is negligible. Inhibition of enzyme activity induced by the herbicide is expressed as percentage inhibition relative to untreated controls. Molar concentrations of compound required for 50% enzyme inhibition ($IC_{50}$ values) are calculated by fitting the values to the dose-response equation using non-linear regression analysis.

Example 4: PPO Enzyme Assay (Recombinant)

Proto is purchased from Sigma-Aldrich (Milwaukee, WI). Protogen is prepared according to Jacobs and Jacobs (N. J. Jacobs, J. M. Jacobs, Assay for enzymatic protoporphyrinogen oxidation, a late step in heme synthesis, Enzyme 28 (1982) 206-219). Assays are conducted in 100 mM sodium phosphate pH 7.4 with 0.1 mM EDTA, 0.1% Tween 20, 5 μM FAD, and 500 mM imidazole. Dose-response curves with the PPO inhibitors saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control, and MC-15608 are obtained in the presence of 150 μM Protogen. The excitation and emission bandwidths are set at 1.5 and 30 nm, respectively. All assays are made in duplicates or triplicates and measured using a POLARstar Optima/Galaxy (BMG) with excitation at 405 nm and emission monitored at 630 nm. Molar concentrations of compound required for 50% enzyme inhibition ($IC_{50}$ values) are calculated by fitting the values to the dose-response equation using non-linear regression analysis. The results are shown in Table x.

Example 5: Engineering PPO-Derivative Herbicide Tolerant Plants Having Wildtype or Mutated PPO Sequences PPO-derivative herbicide tolerant soybean (*Glyceine max*), corn (*Zea mays*), and Canola (*Brassica napus* or

*Brassica Rapa* var. or *Brassica campestris* L.) plants are produced by a method as described by Olhoft et al. (US patent 2009/0049567). For transformation of soybean or *Arabidopsis thaliana*, Wildtype or Mutated PPO sequences encoding mutated PPO polypeptides comprising SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, 224, 225, 226, 227, 228, 229, 230, 231, 232, 233, 234, 235, 236, 237, 238, 239, 240, 241, 242, 243, 244, 245, 246, 247, 248, 249, 250, 251, 252, 253, 254, 255, 256, 257, 258, 259, 260, 261, 262, 263, 264, 265, 266, 267, 268, 269, 270, 271, 272, 273, 274, 275, 276, 277, 278, 279, 280, 281, 282, 283, 284, 285, 286, 287, 288, 289, 290, 291, 292, 293, 294, 295, 296, 297, 298, 299, 300, 301, 312, or 313, are cloned with standard cloning techniques as described in Sambrook et al. (Molecular cloning (2001) Cold Spring Harbor Laboratory Press) in a binary vector containing resistance marker gene cassette (AHAS) and mutated PPO sequence (marked as GOI) in between ubiquitin promoter (PcUbi) and nopaline synthase terminator (NOS) sequence. To facilitate plastid expression, selected constructs as listed in Table 3 below, where operably linked to the Silene *pratensis* ferredoxin transit peptide (tpFNR) as generally described in the description SUPRA. For corn transformation, Wildtype or Mutated PPO sequences are cloned with standard cloning techniques as described in Sambrook etas. (Molecular cloning (2001) Cold Spring Harbor Laboratory Press) in a binary vector containing resistance marker gene cassette (AHAS) and mutated PPO sequence (marked as GOI) in between corn ubiquitin promoter (ZmUbi) and nopaline synthase terminator (NOS) sequence. Binary plasmids are introduced to *Agrobacterium tumefaciens* for plant transformation. Plasmid constructs are introduced into soybean's axillary meristem cells at the primary node of seedling explants via *Agrobacterium*-mediated transformation. After inoculation and co-cultivation with Agrobacteria, the explants are transferred to shoot introduction media without selection for one week. The explants are subsequently transferred to a shoot induction medium with 1-3 μM imazapyr (Arsenal) for 3 weeks to select for transformed cells. Explants with healthy callus/shoot pads at the primary node are then transferred to shoot elongation medium containing 1-3 μM imazapyr until a shoot elongated or the explant died. Transgenic plantlets are rooted, subjected to TaqMan analysis for the presence of the transgene, transferred to soil and grown to maturity in greenhouse. Transformation of corn plants are done by a method described by McElver and Singh (WO 2008/124495). Plant transformation vector constructs containing mutated PPO sequences are introduced into maize immature embryos via *Agrobacterium*-mediated transformation.

Transformed cells are selected in selection media supplemented with 0.5-1.5 μM imazethapyr for 3-4 weeks. Transgenic plantlets are regenerated on plant regeneration media and rooted afterwards. Transgenic plantlets are subjected to TaqMan analysis for the presence of the transgene before being transplanted to potting mixture and grown to maturity in greenhouse. *Arabidopsis thaliana* are transformed with wildtype or mutated PPO sequences by floral dip method as described by McElver and Singh (WO 2008/124495). Transgenic *Arabidopsis* plants are subjected to TaqMan analysis for analysis of the number of integration loci. Transformation of *Otyza sativa* (rice) are done by protoplast transformation as described by Peng et al. (U.S. Pat. No. 6,653,529) TO or T1 transgenic plant of soybean, corn, and rice containing mutated PPO sequences are tested for improved tolerance to PPO-derived herbicides in greenhouse studies and mini-plot studies with the following PPO-inhibiting herbicides: saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control.

Transgenic *Arabidopsis thaliana* plants are assayed for improved tolerance to saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control in 48-well plates. Therefore, T2 seeds are surface sterilized by stirring for 5 min in ethanol+water (70+30 by volume), rinsing one time with ethanol+water (70+30 by volume) and two times with sterile, deionized water. The seeds are resuspended in 0.1% agar dissolved in water (w/v) Four to five seeds per well are plated on solid nutrient medium consisting of half-strength murashige skoog nutrient solution, pH 5.8 (Murashige and Skoog (1962) *Physiologia Plantarum* 15: 473-497). Compounds are dissolved in dimethylsulfoxid (DMSO) and added to the medium prior solidification (final DMSO concentration 0.1%). Multi well plates are incubated in a growth chamber at 22° C., 75% relative humidity and 110 μmol Phot*$m^{-2}$*$s^{-1}$ with 14:10 h light: dark photoperiod. Growth inhibition is evaluated seven to ten days after seeding in comparison to wild type plants. The results are shown in Table 3 below.

TABLE 3

| Species | Gene | Saflufenacil | BAS 850H |
|---|---|---|---|
| *Rhodotermus marinus* (SEQ ID NO: 3 oder 5) | RHOMA_PPO_wt_tpFNR | 1 | 1 |
| *Rhodotermus marinus* (SEQ ID NO: 3 oder 5) | RHOMA_PPO_F353V_tpFNR | 1 | 1 |
| *Opitutus marinus* (SEQ ID NO: 9) | OPITE_PPO_wt_tpFNR | 14 | 9 |
| *Chloroflexus* sp. (SEQ ID NO: 21) | CHLSP_PPO_wt_tpFNR | 640 | 1500 |
| *Escherichia coli* (SEQ ID NO: 184) | hemG_tpFNR | 332 | 4433 |
| *Hydrogenobacter thermophilus* (SEQ ID NO: 27) | HYDTH_PPO_wt_tpFNR | 10 | |
| *Laribacter hongkongensis* (SEQ ID NO: 34) | LARHO_PPO_wt_tpFNR | 1 | |
| *Calditerrivibrio nitroreducens* (SEQ ID NO: 48) | CALNI_PPO_wt_tpFNR | 1 | |
| *Candidatus methylomirabilis* (SEQ ID NO: 54 or 57) | CANME_PPO_wt_tpFNR | 1 | |

TABLE 3-continued

| Species | Gene | Saflufenacil | BAS 850H |
|---|---|---|---|
| *Acinetobacter baylyi* (SEQ ID NO: 312) | AC IB A_hemJ_wt_ tpFNR | 1 | |

Additionally, transgenic T1 *Arabidopsis* plants are tested for improved tolerance to PPO-inhibiting herbicides in greenhouse studies with the following PPO-inhibiting herbicides: saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control.

Example 6: Tissue Culture Conditions

An in vitro tissue culture mutagenesis assay has been developed to isolate and characterize plant tissue (e.g., maize, rice tissue) that is tolerant to protoporphyrinogen oxidase inhibiting herbicides, (saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control). The assay utilizes the somaclonal variation that is found in in vitro tissue culture. Spontaneous mutations derived from somaclonal variation can be enhanced by chemical mutagenesis and subsequent selection in a stepwise manner, on increasing concentrations of herbicide.

The present invention provides tissue culture conditions for encouraging growth of friable, embryogenic maize or rice callus that is regenerable. Calli are initiated from 4 different maize or rice cultivars encompassing *Zea mays* and *Japonica* (Taipei 309, Nipponbare, Koshihikari) and Indica (Indica 1) varieties, respectively. Seeds are surface sterilized in 70% ethanol for approximately 1 min followed by 20% commercial Clorox bleach for 20 minutes. Seeds are rinsed with sterile water and plated on callus induction media. Various callus induction media are tested. The ingredient lists for the media tested are presented in Table y.

TABLE 4

| Ingredient | Supplier | R001M | R025M | R026M | R327M | R008M | MS711R |
|---|---|---|---|---|---|---|---|
| B5 Vitamins | Sigma | | | | | 1.0 X | |
| MS salts | Sigma | | | 1.0 X | 1.0 X | 1.0 X | 1.0 X |
| MS Vitamins | Sigma | | | 1.0 X | 1.0 X | | |
| N6 salts | Phytotech | 4.0 g/L | 4.0 g/L | | | | |
| N6 vitamins | Phytotech | 1.0 X | 1.0 X | | | | |
| L-Proline | Sigma | 2.9 g/L | 0.5 g/L | | | | 1.2 g/L |
| Casamino Acids | BD | 0.3 g/L | 0.3 g/L | 2 g/L | | | |
| Casein Hydrolysate | Sigma | | | | | | 1.0 g/L |
| L-Asp Monohydrate | Phytotech | | | | | | 150 mg/L |
| Nicotinic Acid | Sigma | | | | | | 0.5 mg/L |
| Pyridoxine HCl | Sigma | | | | | | 0.5 mg/L |
| Thiamine HCl | Sigma | | | | | | 1.0 mg/L |
| Myo-inositol | Sigma | | | | | | 100 mg/L |
| MES | Sigma | 500 mg/L | 500 mg/L | 500 mg/L | 500 mg/L | 500 mg/L | 500 mg/L |
| Maltose | VWR | 30 g/L | 30 g/L | 30 g/L | 30 g/L | | |
| Sorbitol | Duchefa | | | 30 g/L | | | |
| Sucrose | VWR | | | | | 10 g/L | 30 g/L |
| NAA | Duchefa | | | | | 50 µg/L | |
| 2,4-D | Sigma | 2.0 mg/L | | | | | 1.0 mg/L |
| $MgCl_2.6H_2O$ | VWR | | | | | 750 mg/L | |
| →pH | | 5.8 | 5.8 | 5.8 | 5.8 | 5.8 | 5.7 |
| Gelrite | Duchefa | 4.0 g/L | | | | 2.5 g/L | |
| Agarose Type1 | Sigma | | 7.0 g/L | 10 g/L | 10 g/L | | |
| →Autoclave | | 15 min | 15 min | 15 min | 15 min | 15 min | 20 min |
| Kinetin | Sigma | | 2.0 mg/L | 2.0 mg/L | | | |
| NAA | Duchefa | | 1.0 mg/L | 1.0 mg/L | | | |
| ABA | Sigma | | 5.0 mg/L | | | | |
| Cefotaxime | Duchefa | | 0.1 g/L | 0.1 g/L | 0.1 g/L | | |
| Vancomycin | Duchefa | | 0.1 g/L | 0.1 g/L | 0.1 g/L | | |
| G418 Disulfate | Sigma | | 20 mg/L | 20 mg/L | 20 mg/L | | |

R001M callus induction media is selected after testing numerou variations. Cultures are kept in the dark at 30° C. Embryogenic callus is subcultured to fresh media after 10-14 days.

Example 7: Selection of Herbicide-Tolerant Calli

Once tissue culture conditions are determined, further establishment of selection conditions are established through the analysis of tissue survival in kill curves with saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control. Careful consideration of accumulation of the herbicide in the tissue, as well as its persistence and stability in the cells and the culture media is performed. Through these experiments, a sub-lethal dose has been established for the initial selection of mutated material. After the establishment of the starting dose of saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control in selection media, the tissues are selected in a step-wise fashion by increasing the concentration of the PPO inhibitor with each transfer until cells are recovered that grew vigorously in the presence of toxic doses. The resulting calli are further subcultured every 3-4 weeks to R001M with selective agent. Over 26,000 calli are subjected to selection for 4-5 subcultures until the selective pressure is above toxic levels as determined by kill curves and observations of continued culture. Alternatively, liquid cultures initiated from calli in MS711R with slow shaking and weekly subcultures. Once liquid cultures are established, selection agent is added directly to the flask at each subculture. Following 2-4 rounds of liquid selection, cultures are transferred to filters on solid R001M media for further growth.

Example 8: Regeneration of Plants

Tolerant tissue is regenerated and characterized molecularly for PPO gene sequence mutations and/or biochemically for altered PPO activity in the presence of the selective agent. In addition, genes involved directly and/or indirectly in tetrapyrrole biosynthesis and/or metabolism pathways are also sequenced to characterize mutations. Finally, enzymes that change the fate (e.g. metabolism, translocation, transportation) are also sequence to characterized mutations. Following herbicide selection, calli are regenerated using a media regime of R025M for 10-14 days, R026M for ca. 2 weeks, R327M until well formed shoots are developed, and R008S until shoots are well rooted for transfer to the greenhouse. Regeneration is carried out in the light. No selection agent is included during regeneration. Once strong roots are established, M0 regenerants are transplant to the greenhouse in square or round pots. Transplants are maintained under a clear plastic cup until they are adapted to greenhouse conditions. The greenhouse is set to a day/night cycle of 27° C./21° C. (80° F./70° F.) with 600 W high pressure sodium lights supplementing light to maintain a 14 hour day length. Plants are watered according to need, depending in the weather and fertilized daily.

Example 9: Sequence Analysis

Leaf tissue is collected from clonal plants separated for transplanting and analyzed as individuals. Genomic DNA is extracted using a Wizard® 96 Magnetic DNA Plant System kit (Promega, U.S. Pat. No. 6,027,945 & U.S. Pat. No. 6,368,800) as directed by the manufacturer. Isolated DNA is PCR amplified using the appropriate forward and reverse primer.

PCR amplification is performed using Hotstar Taq DNA Polymerase (Qiagen) using touchdown thermocycling program as follows: 96° C. for 15 min, followed by 35 cycles (96° C., 30 sec; 58° C.-0.2° C. per cycle, 30 sec; 72° C., 3 min and 30 sec), 10 min at 72° C. PCR products are verified for concentration and fragment size via agarose gel electrophoresis. Dephosphorylated PCR products are analyzed by direct sequence using the PCR primers (DNA Landmarks, or Entelechon). Chromatogram trace files (.scf) are analyzed for mutation relative to the wild-type gene using Vector NTI Advance 10™ (Invitrogen). Based on sequence information, mutations are identified in several individuals. Sequence analysis is performed on the representative chromatograms and corresponding AlignX alignment with default settings and edited to call secondary peaks.

Example 10: Demonstration of Herbicide-Tolerance

TO or T1 transgenic plant of soybean, corn, Canola varieties and rice containing PPO1 and or PPO2 sequences are tested for improved tolerance to herbicides in greenhouse studies and mini-plot studies with the following herbicides: saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control. For the pre-emergence treatment, the herbicides are applied directly after sowing by means of finely distributing nozzles. The containers are irrigated gently to promote germination and growth and subsequently covered with transparent plastic hoods until the plants have rooted. This cover causes uniform germination of the test plants, unless this has been impaired by the herbicides. For post emergence treatment, the test plants are first grown to a height of 3 to 15 cm, depending on the plant habit, and only then treated with the herbicides. For this purpose, the test plants are either sown directly, and grown in the same containers or they are first grown separately and transplanted into the test containers a few days prior to treatment.

For testing of TO plants, cuttings can be used. In the case of soybean plants, an optimal shoot for cutting is about 7.5 to 10 cm tall, with at least two nodes present. Each cutting is taken from the original transformant (mother plant) and dipped into rooting hormone powder (indole-3-butyric acid, IBA). The cutting is then placed in oasis wedges inside a bio-dome. Wild type cuttings are also taken simultaneously to serve as controls. The cuttings are kept in the bio-dome for 5-7 days and then transplanted to pots and then acclimated in the growth chamber for two more days. Subsequently, the cuttings are transferred to the greenhouse, acclimated for approximately 4 days, and then subjected to spray tests as indicated. Depending on the species, the plants are kept at 10-25° C. or 20-35° C. The test period extends over 3 weeks. During this time, the plants are tended and their response to the individual treatments is evaluated. Herbicide injury evaluations are taken at 2 and 3 weeks after treatment. Plant injury is rated on a scale of 0% to 100%, 0% being no injury and 100% being complete death.

Example 11: Herbicide Selection Using Tissue Culture

Media is selected for use and kill curves developed as specified above. For selection, different techniques are utilized. Either a step wise selection is applied, or an immediate lethal level of herbicide is applied. In either case, all of the calli are transferred for each new round of selection. Selection is 4-5 cycles of culture with 3-5 weeks for each cycle. Cali are placed onto nylon membranes to facilitate transfer (200 micron pore sheets, Biodesign, Saco, Maine). Membranes are cut to fit 100×20 mm Petri dishes and are autoclaved prior to use 25-35 calli (average weight/calli being 22 mg) are utilized in every plate. In addition, one set of calli are subjected to selection in liquid culture media with weekly subcultures followed by further selection on semi-solid media. Mutant lines are selected using saflufenacil, 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4), flumioxazin, butafenacil, acifluorfen, lactofen, bifenox, sulfentrazone, and photosynthesis inhibitor diuron as negative control. Efficiencies of obtaining mutants is high either based on a percentage of calli that gave rise to a regenerable, mutant line or the number of lines as determined by the gram of tissue utilized.

Example 12: Maize Whole Plant Transformation and PPO Inhibitor Tolerance Testing Immature embryos are transformed according to the procedure outlined in Peng et al. (WO2006/136596). Plants are tested for the presence of the T-DNA by Taqman analysis with the target being the nos terminator which is present in all constructs. Healthy looking plants are sent to the greenhouse for hardening and subsequent spray testing. The plants are individually transplanted into MetroMix 360 soil in 4" pots. Once in the greenhouse (day/night cycle of 27° C./21° C. with 14 hour day length supported by 600 W high pressure sodium lights), they are allowed to grow for 14 days. They are then sprayed with a treatment of 25 to 200 g ai/ha saflufenacil+1.0% v/v methylated seed oil (MSO) and/or 25-200 g ai/ha 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) plus 1% MSO. Other PPO inhibiting herbicides are also tested in a similar fashion for confirming cross resistance: flumioxazin, butafenacil, acifluorfen, lactofen, bifenox, sulfentrazone, and photosynthesis inhibitor diuron as negative control. Herbicide injury evaluations are taken at 7, 14 and 21 days after treatment. Herbicide injury evaluations are taken 2, 7, 14 and 21 days post-spray to look for injury to new growth points and overall plant health. The top survivors are transplanted into gallon pots filled with MetroMix 360 for seed production.

Example 13: Soybean Transformation and PPO Inhibitor Tolerance Testing

Soybean cv Jake is transformed as previously described by Siminszky et al., Phytochem Rev. 5:445-458 (2006). After regeneration, transformants are transplanted to soil in small pots, placed in growth chambers (16 hr day/8 hr night; 25° C. day/23° C. night; 65% relative humidity; 130-150 microE m-2 s-1) and subsequently tested for the presence of the T-DNA via Taqman analysis. After a few weeks, healthy, transgenic positive, single copy events are transplanted to larger pots and allowed to grow in the growth chamber. An optimal shoot for cutting is about 3-4 inches tall, with at least two nodes present. Each cutting is taken from the original transformant (mother plant) and dipped into rooting hormone powder (indole-3-butyric acid, IBA). The cutting is then placed in oasis wedges inside a bio-dome. The mother plant is taken to maturity in the greenhouse and harvested for seed. Wild type cuttings are also taken simultaneously to serve as negative controls. The cuttings are kept in the bio-dome for 5-7 days and then transplanted to 3 inch pots and then acclimated in the growth chamber for two more days. Subsequently, the cuttings are transferred to the greenhouse, acclimated for approximately 4 days, and then sprayed with a treatment of 0-200 g ai/ha saflufenacil plus 1% MSO and/or 25-200 g ai/ha 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione (CAS 1258836-72-4) plus 1% MSO. Other PPO inhibiting herbicides are also tested in a similar fashion for confirming cross resistance: flumioxazin, butafenacil, acifluorfen, lactofen, bifenox, sulfentrazone, and photosynthesis inhibitor diuron as negative control. Herbicide injury evaluations are taken at 2, 7, 14 and 21 days after treatment. Results are shown in Table xxx.

| Rating | Phenotype (phytotoxicity) of surviving plants |
|---|---|
| 1 | no obvious damage (no phytotoxicity) |
| 2 | minor amount of leaf damage, plant will survive |
| 3 | moderate amount of leaf damage, plant will survive |
| 4 | severe amount of leaf damage, plant will survive |
| 5 | no surviving plants-all plants dead/dying |

The following gives a definition of the injury scores measured above:

Score Description of Injury

| | |
|---|---|
| 0 | No Injury |
| 1 | Minimal injury, only a few patches of leaf injury or chlorosis. |
| 2 | Minimal injury with slightly stronger chlorosis. Overall growth points remain undamaged |
| 3 | Slightly stronger injury on secondary leaf tissue, but primary leaf and growth points are still undamaged. |
| 4 | Overall plant morphology is slightly different, some chlorosis and necrosis in secondary growth points and leaf tissue. Stems are intact. Regrowth is highly probable within 1 week. |
| 5 | Overall plant morphology is clearly different, some chlorosis and necrosis on a few leaves and growth points, but primary growth point is intact. Stem tissue is still green. Regrowth is highly probably within 1 week. |
| 6 | Strong injury can be seen on the new leaflet growth. Plant has a high probability to survive only through regrowth at different growth points. Most of the leaves are chlorotic/necrotic but stem tissue is still green. May have regrowth but with noticeable injured appearance. |
| 7 | Most of the active growth points are necrotic. There may be a single growth point that could survive and may be partially chlorotic or green and partially necrotic. Two leaves may still be chlorotic with some green; the rest of the plant including stem is necrotic. |
| 8 | Plant will likely die, and all growth points are necrotic. One leaf may still be chlorotic with some green. The remainder of the plant is necrotic. |
| 9 | Plant is dead. |
| * | Not tested |

Example 14: Transient Protein Expression in Tobacco Leafs

Transient expression of PPO sequences (e.g. SEQ ID NO: 184) as wildtype or with respective mutations were done as described previously (Voinnet O., et al., 2003, The Plant Journal 33, 949-956). In brief, cloning of GOI and *Agrobacterium* transformation (strain: GV2260) were done as described in EXAMPLE 5. Young leaves of

*Nicotiana benthamiana* were infiltrated with transgenic *Agrobacterium* suspension ($OD^{600}$ of 1.0) harboring binary vector constructs containing a GO/gene controlled by a promoter and terminator sequence. 48 h to 72 h after infiltration punches of leave discs (0.75 cm in diameter) were transferred to 6-well plates with medium (half strength Linsmaier-Skoog (Linsmaier and Skoog (1965) Physiol. Plant. 18: 100-127) nutrient solution or water) containing herbicide of interest in different concentrations. Multi well plates were incubated in a growth chamber at 22° C., 75% relative humidity and 110 μmol Phot*$m^{-2}$*$s^{-1}$ with 14:10 h light: dark photoperiod.

Example 15: Demonstration of Herbicide Tolerance of Transiently Transformed Tobacco Leaf Discs Leaf discs, generated as described in EXAMPLE 14, expressing a protein encoded by GOI, were subjected to analysis on improved tolerance to herbicide treatment. For analysis of herbicide damage, chlorophyll fluorescence were identified as indicative marker (Dayan and Zaccaro (2012) Pest. Biochem. Physiol. 102: 189-197). In addition to monitor herbicide effect by visual inspection the photosynthetic yield of photosystem II were done with a MAXI imaging PAM machine (IMAGINE-PAM M-Series, Walz, Effeltrich, Germany) 48 h after starting herbicide treatment. PSII yield were measured as per manufacturer instructions. Tolerance factors were calculated based on $IC_{50}$ values of PSII yield inhibition of transformed versus empty vector-transformed leaf discs. $IC_{50}$ of PSII yield inhibition in empty vector-transformed leaf discs treated with Saflufenacil or 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione for 48 h was measured with $1.1*10^{-7}$ M or $1.1*10^{-8}$ M, respectively.

SEQUENCE LISTING (322 sequences)

SEQ ID NO: 1 - protein, 534 aa, Amaranthus
MVIQSITHLSPNLALPSPLSVSTKNYPVAVMGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFGKEFVDYVIDPFVAGTCGGDPQSLSMHHTFPEVWNIEKRFGSVFAGLIQSTLLSKKEKGGENASIKKPRVRGSFSFQGGMQTLVDTMCKQLGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

SEQ ID NO: 2 - protein, 461 aa, Salinibacter
MPNVGIIGAGISGLAAAYRLQEHGHSVRVLEASGHTGGVIRSESSEGFLVEHGPNSIRAGAAGLETLIDALDLHEDRVWANDAADTRYVVRDGRPTPLPRSVGSFLTTDLFSTRAKLRLLAEPFIGRAAAEDESVARFTERRLGPEVLNYAVAPFVGGVFAGRPDDLSVQHAFRRLAALEEESGSLLLGAIRRALTSDDGAPPDTPSGLFSFRNGLQTLPNALADTLGDRIRLNAPVHALTHDGTAWRVTVSPPDAPAHTRSFDALVCTVPLHRLAAMEIDTPVDLAPLGEVTYPPLSVLALGYERDAIDHALDGFGMLVPPVEDTLDVLGTIFSSTLFPGRAPEGHVLLTTFVGGARAPHHATSDAAALQARVARDLDSLLGVDASPVFRRLVHWPHAIPQYELGYGTVKDTFDALEAAHPHLAFAGNYRAGVSVGDALTSGLEAADRLLETDERATQPH

SEQ ID NO: 3 - protein, 469 aa, Rhodothermus
MASVGIIGAGIAGLTAAYELHRRGLEVTVFEATDRIGGFIQSERIDGFLVELGPQTLQRTSGDFEELLRQVDLEDACIPARPVAANRFIVRGGQPIPLPRSPRELLRTPLLSPRARLRLLAEPFIHRAHRSTEESVAKFTRRRLGPEVLDYLVEPFVAGIFAGDPEQLSVRYAFPKLFELEQQYGSLFWGLIRDRMKQRYHPAPRRSMFSFVEGLHMLPRALAERLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 4 - protein, 461 aa, Salinibacter
MPNVGIIGAGISGLAAAYRLQEHGHSVRLLEASGHTGGVIRSESSEGFLVEHGPNSIRAGAAGLETLIDALDLHEDRVWANDAADTRYVVRDGRPTPLPRSVGSFLTTDLFSTRAKLRLLAEPFIGRAAAEEESVARFTERRLGPEVLNYAVAPFVGGVFAGRPDDLSVQHAFRRLAALEEESGSLLLGAIRRALTSDDGAPPDTPSGLFSFRNGLQTLPNALADTLGDRIRLNAPVHALAHDGTAWRVTVSPPDAPAHTRSFDALVCTVPLHRLAAMEIDTPVDLAPLGEVTYPPLSVLALGYGRDAIDHALDGFGMLVPPVEDTLDVLGTIFSSTLFPGRAPEGHVLLTTFVGGARAPHHATSDAAALQARVARDLDSLLGVDASPVFRRLVHWPHAIPQYELGYGTVKDTFDALEAAHPHLAFAGNYRAGVSVGDALTSGLEAADRLLETDERAAQPH

SEQ ID NO: 5 - protein, 469 aa, Rhodothermus
MASVGIIGAGIAGLAAAYELHRRGLEVTVFEATDRIGGFIQSERIDGFLVEHGPQTLQRTSGDFEELLRQVDLEDACITARPIAANRFIVRGGRPIPLPRSPRELLRTPLLSPRARLRLLAEPFIHRAHRSTEESVAKFARRRLGPEVLDYLVEPFVAGIFAGDPEQLSVRYAFPKLFELEQQYGSLFWGLIRDRMKQRYHPAPRRSMFSFVEGLHMLPRALADRLPAHAIVRNAEVLAIRWDEKNPWTLTFRQHGRASTRFFDIIVCAVPLHRLAQLRIHPPVDRRPLSTVEHPPIALVALGFRREQVAHPLDGFGMLVPAVERDFQILGTLFSSSLFPDRAPEGHVLLTTFVGGMRHPELALLPEDRLEALVLQDLRRLLGISGAPVFRHVWRWERSIPQYRLGYDAVLACVHDVEMSRSGLFLAGNYMEGISVIDALHTGLKAARAIIQHLREEAAGGLAKLVLGD

SEQ ID NO: 6 - protein, 472 aa, Halothio
MNTHSNASEPINCPYLVIGGGISGLATAYHLSRMGKTVTVLEATSRVGGAVGSIEEDGWLRELGPNSLVQTPEMAALMSALDLVSEIIEANTVAKKRFVAKNGHPVALPGSPLELLTSPLFSMGDLWHLAREAWIKPVNKEETIAEFVRRRLGQGFLDWAVDPFVSGVYAGDPNRLSVQAAIPKIYAFEQESGSLIRGGIAKMKAAKANPAPVTLPAKGKLFSFKRGLQTLTDALATAITSSGRGNIQLDSAITNIQRLPEGGWSVKTVQGKTFHTRQLILSTPAHVSAQLLGEVDGPLAETLAAIEYPPVTSVVMGFDRSEVAHPLDGFGLLLPSKEKKRTLGVLFSSTLFPDRTPAGKVLLSAFIGGRKHPEAAQGDDQELLDRVLGDLSPLLGIKGKPEFLRVKRWQQAIPQYEIGYLELQEKISQRLTALPGLSLNGNWRGGIAVGDCLNNGNKLAERLIENTRTEES

SEQ ID NO: 7 - protein, 441 aa, Coralio
MPDTCIIGAGITGLATAWQYQRKGKDCVVLESGPQVGGAIQSILQDGYLAEEGPNSIQLNSLEIEDFLTSIPGLEAQIIEANPAAQKRYIVRKGRLRAVPMNPLQAITTQLWSIAGKLRVLREPFIKAAPPEPDQSVADFVTRRLGKELYDYAINPLVGGIYAGKPEMLSLRYGFPKLYALEQEHGGLIRGALAKMKAAKANKGPKAKKYILSFKDGLQTLPQSIANNLNEPVQTGVSIESIRQIEDMWAVRWNGQVKAFKELIVTVPAHKLPGLPFEEPIRLPAIDYPPVSVISLGYPLSAIKQPLDGFGALVPEREDRNILGVLFPSAVFDGRAPEGHGLLTVFVGGSRSPECSSPDTDQLLKTIQPDLETLLGIQDEPSFVHHKHWPMAIPQYTLGYEKVLEAITRIEQQYIGLKLAGNYRTGISLSYCLESAIASTN

SEQ ID NO: 8 - protein, 463 aa, Magnetococcus
MTKNPILIIGGGISGLSTAWFLHKKGEKVILLESRDRVGGNIRTSRNPEGYLIEHGPNSTLQKPGDEEDALGRIITDMALESELQEANPLAARRFVMKGGQLHVLPTSPPGFIKTPLFSLSAKLRLCLEPFIGKSEQEESIAQFVIRRLGQEFLDYAIEPFVSGVYAGDPKQLSVRAAVAKIYALEAKYGSLIKGAIALGKIRKAAGMPRGRMISFETGMETLPATIANRLPHQSIHTNAQVTALCQHGAAWQVSWQQGGQHGGEPHSIIASQVVLATPASVSAQLLRPLSPQAADLLESIRYAPVDSVALGYAKQDINHSLDGFGFLIPRKEQVTTLGGLFSTTLFPGRAPQDKALLTCFIGGMTNPSITQWSEEKVVTQVDQDMMAALGIQHGAEYVHLTRYTHAIAQYEQGHLQRVGDIDRALAGYKGLHLRANWRDGVSVSDCVLNGEKSAQKILAGVS

SEQ ID NO: 9 - protein, 467 aa, Opitutus
MSTSPFNPSATASGRPPKTFAVLGAGITGLTAAHRLTQLGHKVRVFEQSDRVGGSIKTEEVDGWLIEGGPNTLLSGELAVDKLIDELGLNGERIAADPAAKNRYIVRRGRALAAPMSPPSFFASSLFSPVAKFKLLAELFARRRVRTTDVSLAEFVESHFGREFVDYALNPFVGGVYAGDPEKLSARQSFPKLWEIEQTHGSLIRGQIAAAKARKARGEPRPGIFSFKHGLHVLPEALAARLPAGAITLGASLDAIVPGDKWNVVWHDDVATHTQSFDSVVVALPAPALARLQIGTLGEKPLAALALIEHPPVSSLFLGFRREQVAHPLDGFGVLVPAVEKRSVLGVLFSSSLFPGRAPLGHVALTVMVGGTRQPQLASLPADQLLAAVRPDLTQLLGVSGDPVFVRHNFWPRAIPQYNLGHEHFIAALAAGERFHPGLFMGGQARDGIAVPACIAAGEKLAERAGQ

SEQ ID NO: 10 - protein, 451 aa, Melioribacter
MSKKIVVLGAGISGLSTAYWLVKKGYDVTILETKNEPGGSMISRRLDNFLIDYGPNSGLETTPLIRKLVEEVNLSDKMIYANAAASKRYILKNGELIPLPMSPGSFIRTKLFSSGAKFRLMAEPFVSKSDDGYYQSIAEFVRRRLGNEFLDYAIDPFVSGVFAGDPEKLSVKSAFPKLYRLEEVYGGLIKGMIKGARERKQRNEESKQSAKMFSFLEGMQSLPNAIADKLKDNIVFSAKVLNVTGANDKQWKVTYELNGNRESITADTVISTLPAYIAAGVFGELDQKLAERLNSIYYPPVMVLYLGYNKKDIKRKLDGFGFLIPSKEKKHFLGAIWSSSIFPGRSPEDMAAFTLFVGGARSPQLFEMEKSDLIKKVLSEFHQIMNIKGEPVLIENKLWQKAIPQYNLGYIEHEKYFEVFEENHRGIYLRGNYRGGISVGDCIKNSELEIK

SEQ ID NO: 11 - protein, 501 aa, Physcomitrella
VAVVGAGVSGLAAAHRLRSAGVAVTVFEAQNAVGGKIQSFSNDGLIWEQGPNTMVETEPEVSSLIDELGLREKQQWPVMQNKRYVVRDGKAVQLPSNPLGLITTKLLSAQAKCQILLEPFLWKRKEVPLKEAANGRENVGNFITRHFGREVVDYLVDPFIAGTSGSDPDSVSIRHTFPDLFAIEERYGSLLIGGVKSSFKKKSGSKKESFKVQSDSAKVTPAQKRPRGSFSFVGGMQTLAHALSERLDEESLELNSSVLNLASDQQGNPSRNNWTVTYKKENSQQKEKHFDAVILTTPLHNLQELGIEKNGIPYALDFIPEIVYQPMSVIVTAFKESDVKNSLKGFGVLVPRMEKKNGFFTLGTMFSSSMFPDRAPPGQVVFTTFVGGSRNRALASAPFEEVKAVALEDLRKIVGVQGPPVAVKHIFWKQAFPQYSLDYNEFLSSLEKMESDLPGLFYAGNHRGGLSVGKSVASGCKAAEHVLSMLEGTGGRKIFTMASTK

SEQ ID NO: 12 - protein, 511 aa, Ricinus
MSSVIKEDRNPSHVKRVAVVGAGVSGLAAAYKLKSHGLKVTVFEAEERAGGKLRSVNHDGLIWDEGANTMTESEMEVKSLIGNLGIREKQQFPISQNKRYIVRNGKPILIPTNPIALITSNILSAQSKFQIILEPFLWKKRESSETHNAYTEESVGEFFQRHFGKEVVDYLIDPFVAGTSAGDPESLSVCHSFPELWNLEKRFGSIIAGVVQAKLSTKRGKSQETKGSSVKKKQQRGSFSFFGGMQTLTDTLCKALAKDELRLESKVFSLSYNPDSKSAVENWSLSYAFKGAKHLQNSSYDAIVMTAPLCNVKEMKITKNRNIFSLNFLPEVSYMPLSVVITTFKKDNVKSPLEGFGVLVPSKEQQNGLKTLGTLFSSMMFPDRAPNDLYLYTTFVGGSRNKELAKASTDDLKQIVTSDLRQLLGAEGEPTFVNHFYWSKAFPLYGRNYDAVLEAIDTMEKDLPGFFYAGNHKGGLSVGKAIASGCKAADLVISYLESSSDDKMLKEGPSN

SEQ ID NO: 13 - protein, 476 aa, Chromohalobacter
MQHEEQLDATDQAVGEARRDVVVVGGGASGLAAARAAARRGLAVSVLERGSHAGGNLRTHRDGAWQVEVGPNTLVMKPPLHTLLDELGLLDEAQPANPDARRRYIAFHGRPVALPTHVLKAPANPLIGLRGSWSVLREPFRAGPPRDEESLADFVVRRLGRHVLDHLVDPFVSGVYAGDPARLSAQAAMPRLVALEREYGSLVRGGLRRLRQSRREPPALPREWRGQLVSFPAGLQRLAERLAEDIADQPGASVQCGCEVVAVGREADGWQVETAAGQRIRTRELVLAVPAPTAAALLAPLDAALAAPLEEIAYPPVNAVSVGFRRADVDHPLDGFGMLIPGVERRRTLGALFSSTLFPGRAPSDHVLLTAFLGGRRQPEAAAGDDAEQVAQVVADLGDLLGIHAEPVWQCVSRWPQAIPQYERGHLARIAALDAALEAHPGLSLLGNWRDGIAVGDCLENGRRLGERLAETPDRR

SEQ ID NO: 14 - protein, 462 aa, Leptospirillum
MAGFDCDTLVVGGGVSGLAAALTLKNRGVDVRLLESRGYLGGAIRTVREDGYLLEFGPNSLMVRPEDAIDTVLGDPELRARIVPASGLSKNRYVVKAGHLYPVPLSPWAFFRTPLLSWRGRRDILSEWKVPPRTGGPEETLSHFVRRRLGEEALDYFVDPFVKGVYASHPDLLSVEAAFPLLVRLEREHGGLLRGALKTFLKRRKRPSGSSPRGIFSFAGGMTDLVEAMGKRLGEDVGTNVDVIKYTRLEEGFRVALMYDETEYYMTSRRLILATSAPQAAELLEGDPDGPSSELKSIPYAPVTIAYAGFLREQVTHPLDGFGLLCPTVENRKVLGVIFSSSLFPGRAPEGKVLLTVFVGGMTGQKLAQAFDEDLERIVLKELTELLGVKGAPSFFRIHRWEKAIPQLILGHRETVRTIRKKLPSGLRLAGNYLDGISIARAFASGVRAAEELLSEDGGTPG

SEQ ID NO: 15 - protein, 514 aa, Selaginella
MAMAEGETVPVLGSVAVVGAGASGLAAAYRLRAAGVSVTVYEAENSIGGKLKSVSENGFIWEKGPNTMTENDPSISRMFDDLHLRDKQQFPVEQKKRYIVRNASPTMLPSNPLGFITTGLFSAQAKLKLLTEPFSWKRTKAESNEDESVGAFMERHFGDEIVDYAVDPFVAGTSGSDPSSISIRHSFPELWSLEKNYGSLFVGAIKSGFSKKKKQKLRPVEFEDEDSDFPARTRPRRGGSFSFVGGMQTLANELVSRIGKEKFKLNTFVTGLACNQQGNPSRQSWTVTGLETSGKRSKRSDKTFDAVIMTAPVDDVRTMKVVKDGKPYALDYLPTVIYEPMSVLITMFNKDSVKRALPGFGVLVPSKEQQANGFQTLGTLFSSFMFPDRAPEDQLLFTTFIGGSRNTLLASRSKEELLDVTLKDLSRLIGVEGQPTAMRHVYWEKAFPRYSIGYDNVLNSIQKLESDLPGLFYAGNHRGGLAVGKTIVSGLDAAEQVLQYLQGSGGKKVFTMAS

SEQ ID NO: 16 - protein, 520 aa, Selaginella
MAMAEGETAPVLGSVAVVGAGASGLAAAYRLRAAGVSVTVYEAENSIGGKLKSVSENGFIWEKGPNTMTENDPSISRMFDDLHLRDKQQFPVEQKKRYIVRNASPTMLPSNPLGFITTGLFSAQAKLKLLTEPFSWKRTKAESNEDESVGAFMERHFGDEIVDYAVDPFVAGTSGSDPSSISIRHSFPELWSLEKNYGSLFVGAIKSGFSKKKKQKLRPVEFEDEDSDFPARTRPRRGGSFSFVGGMQTLANELVSRIGKEKFKLNTFVTGLACNQQGNPSRQSWTVTGLETSGKRSKRSDKTFDAVIMTAPVDDVRAMKVVKDGKPYALDYLPTVIYEPMSVLITMFNKDSVKRALPGFGVLVPSKEQQANGFQTLGTLFSSFMFPDRAPEDQLLFTTFIGGSRNTLLASRSKEELLDITLKDLSRLIGVEGQPTAIRHVYWEKAFPRYSIGYDNVLHSIQKLESDLPGLFYAGNHRGGLAVGKTIVSGLDAAEQVLQYLQGSGGKKVFTMASLEQPVS

SEQ ID NO: 17 - protein, 508 aa, Arabidopsis
MASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMLPTNPIELVTSSVLSTQSKFQILLEPFLWKKKSSKVSDASAEESVSEFFQRHFGQEVVDYLIDPFVGGTSAADPDSLSMKHSFPDLWNVEKSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAVIMTAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDSL

SEQ ID NO: 18 - protein, 454 aa, Acidithiobacillus
MSSETVIVVGAGLTGLSATWYLHQRGIPALLLEAEAEVGGNLRSRSEDGFLRDLGPNSLMIKGDLLPDLIRQLQLEDRVVEANPLARRRFVLNRRGHPVALGPDVLFSSSLLSLSARLRLLSEPWRPRRPQSQNDESIADFVRRRLGPEALTWMVDPFVSGVFAGDPEKLSVTAALPRLAAMEAESGSLLRAALRRRRAGKKEGSSRLVSFRGGLQELPRALAARLPPDRLALSRPLTHLQRRGELWHLQTPAGDLECRRLVLALPAAESARLLRAEAPELAAELEAIVYPAVATVALGFPREAVDHRLDGFGLLIPRRLGIETLGVLFSSTLFPERAPPGMVLLTAFLGGAQQDISGRSPAELEAQALADLRPILGIRGDPAYHRCALWPRAIPQYALGHRQRVERIHELRRQLAGLELLGNWQGGVALGDCVVQADAFQRTFAQVDTATGPS

SEQ ID NO: 19 - protein, 512 aa, Arabidopsis
MESGAVGDHDTKFESISGKRVAVVGAGVSGLAAAYKLKSRGLNVTVFEADERAGGKLTSVMQNGLIWDQGANTMTEAEPEVGSLLDDLGLRDKQQFPISQKKRYIVRNGLPMMLPTNPIELVTSSVLSTQAKIQILLEPFLWKKNDSSSKVSDASAEESVSGFFQRHFGQEVVDYLIDPFVGGTSAADPDSLSMKHSFPDLWNVEKSFGSIIVGAIRTKLAAKGGKSGEAKSSPGTKRGSRRSFSFKGGMQILPDMLCKSLSHDEINLDSKVLSLSYNSGSRQENWSLSCVSHNETQRQNLHYDAVVMTAPLCNVKEMKVTKGGQPFLLNFLPEINYMPLSVLITTFTKEKVKRPLEGFGVLIPSKEKKHGFKTLGTLFSSMMFPDRCPSDLHLYTTFIGGSRNQELAKASTDELKQVVTSDLQRLLGVEGEPVSVNHYYWRKAFPLYDSSYGSVMEAIDKMEKDLPGFFYAGNHRGGLSIGKSIASGCKAADLVISYLESCSNDKKPDESL

SEQ ID NO: 20 - protein, 502 aa, Glycine
MASSATDDNPRSVKRVAVVGAGVSGLAAAYKLKSHGLDVTVFEAEGRAGGRLRSVSQDGLIWDEGANTMTESEIEVKGLIDALGLQEKQQFPISQHKRYIVKNGAPLLVPTNPAALLKSKLLSAQSKIHLIFEPFMWKRSDPSNVCDENSVESVGRFFERHFGKEVVDYLIDPFVGGTSAADPESLSMRHSFPELWNLEKRFGSIIAGALQSKLFAKREKTGENRTALRKNKHKRGSFSFQGGMQTLTDTLCKELGKDDLKLNEKVLTLAYGHDGSSSSQNWSITSASNQSTQDVDAVIMTAPLYNVKDIKITKRGTPFPLNFLPEVSYVPISVMITTFKKENVKRPLEGFGVLVPSKEQKNGLKTLGTLFSSMMFPDRAPSDLYLYTTFIGGTQNRELAQASTDELRKIVTSDLRKLLGAEGEPTFVNHFYWSKGFPLYGRNYGSVLQAIDKIEKDLPGFFFAGNYKGGLSVGKAIASGCKAADLVISYLNSASDNTVPDK

SEQ ID NO: 21 - protein, 474 aa, Chloroflexus
MMAGYDSVVIGGGIAGLAAAYTLHKRGYRVLVIESTNRVGGVIQTITTPEGYILDCGPNTVGTGDARLWQELIDLGLRERITPAAPCSKRRFILINGTPVEIPTSPVGLITTRLLSWRGKLRVLAEPFINRGSTDPDESVAAFFTRRIGAEATAHLLDPFVAGVYAGDPQRLSTAAVFPSLWEAAQRSGSIVRGMLSKPKPKTQVSEPKMRSRTFTFRGGLAEWPRALAQALGAGNVWTERRVVKLQPRDSWWEVTIDGVNGPETLISRSLIIATPAFTAADLIESVDQRAAGALRGIPYAPVAVVHLGFRRDQISQELSGFGVLAPSSEQRQFLGILWTSSIFPHVAPHDHVLTTTLSGGAIRPELAERSDETLIEAAIRDHHQLLGIRGQPIFTHVTRWRTAIAQYTFGHRERIATLVQLEQRLPTIQFAGSYRDGVGVPKTWASGVQAGERIAAALAAHGTTAVSTETASG

SEQ ID NO: 22 - protein, 499 aa, Medicago
MASSAKDDNPRSVKRVAVVGAGVSGLAAAYKLKSHGLDVTVFEAEGRAGGRLRTVSRDGLVWDEGANTMTENEIEVKGLIDALGLHEKQQYPLSQHKRYIVKNGTPVLVPANPAALLKSKLLSAQSKIQVIFEPFMWKRSDSSAVRDENSEESVSRFFERHFGKEVVDYLIDPFVGGTSAAGPESLSIRHSFPELWNLEKRFGSIIAGALQSSVFGKKDKAGETKDVPRKNKHQRGSFSFQGGMQTLTDTLCKELGKDDIKLNAKVLTLAYSHDGSSPSQNWSITCTSNRKAQDVDAVIMTAPLGNVRDIQIKKKGNPFPLNFLPEVTYLPLSVLITTFKKENVKRPLEGFGVLVPSKEQQNGFKTLGTLFSSMMFPDRAPSDMHLYTTFIGGTRNRELAQASTDELTKIVTSDLRKLLGAEGEPAFVNHFFWSKGFPLYGHNYGSVLEAIDKMEKDLPGFFYAGNHRGGLSVGRAIASGCKAADLVISYLNNASDNSV

SEQ ID NO: 23 - protein, 475 aa, Chloroflexus
MMMANYDSVVIGGGIGGLAAAYTLYKRGYRVLVIEAANRVGGVIHSITTPEGFTLDCGPNTIGTNDVRLWQELIDLGLRDRIRPAARCGRRRYILINGTPIEIPSSPVGLITTRLLSWRGKLRVLGEPFVNIGTPTGEESVAAFFSRRIGHEAVAHLLDPFVAGVYAGDPNQLSAAAVFPSLWEAVQRGGSIVRGMLRRPKQKTLISEPKMRSRTFSFQGGLADWPRAIARALGTGNVWTGRRAVGLRDLGTYWEVTVDGTGRLETITTRSVIIATPAYVAAELVEALDPAAASALRSIPYAPVSVVHLGFRRDQLSHELNGFGVLAPSSERRQFLGILWASSLFPHVAPPDRVLTITLSGGAIRPEVAEQSEEALIESAIRDNQEVLGIRGQPLLTHVTRWHHAIAQYTLGHRERIATLERLEQRRPTLQLTGSYRGGIGIPKTWASGVGAGERIAAALDAQGTTADTLEQARG

SEQ ID NO: 24 - protein, 508 aa, Vitis
MAEKSDAQSHYNGSGKRVAVVGAGVSGLAAAYKLKLHGVNITLYEAEERAGGKLRSVSQHGLVWDEGANTMTESEIEVGSLLDNLRLREKQQFPISQNKRYIVRNGMPVLLPSNPIALIKSNILSAKSKFQIILEPFLWKKSDLSKVSDDHMKESVGGFFQRHFGKEVVDYLIDPFVAGTSGGDPESLSMHHTFPELWNLEKRFGSIIAGAVLSKLSAKREKRGETKGSSEKKKRQRGSFSFQGGMQTLTDTLCKELGKDKLRLKSKVLSLSYSHGEKSALENWSVAYASNPGKQSKDLSFDAVIMTAPLCNVREMKIMKKGNPFLLDFLPEVSYLPLSVIITTFKKENVKRPLEGFGVLVPSKEQQNGLKTLGTLFSSMMFPDRAPNDLYLYTTFIGGSRNRELAKASTDELKQIVTSDLRQLLGAEGEPTFVNHFYWSKAFPLFGHNYDSVLEAIDKMEKDLPGFFYAGNHKGGLSVGKAIASGCKAADLVISYLNSSSDGKMFKE

SEQ ID NO: 25 - protein, 544 aa, Zea
MLALTASASSASSHPYRHASAHTRRPRLRAVLAMAGSDDPRAAPARSVAVVGAGVSGLAAAYRLRQSGVNVTVFEAADRAGGKIRTNSEGGFVWDEGANTMTEGEWEASRLIDDLGLQDKQQYPNSQHKRYIVKDGAPALIPSDPISLMKSSVLSTKSKIALFFEPFLYKKANTRNSGKVSEEHLSESVGSFCERHFGREVVDYFVDPFVAGTSAGDPESLSIRHAFPALWNLERKYGSVIVGAILSKLAAKGDPVKTRHDSSGKRRNRRVSFSFHGGMQSLINALHNEVGDDNVKLGTEVLSLACTFDGVPALGRWSISVDSKDSGDKDLASNQTFDAVIMTAPLSNVRRMKFTKGGAPVVLDFLPKMDYLPLSLMVTAFKKDDVKKPLEGFGVLIPYKEQQKHGLKTLGTLFSSMMFPDRAPDDQYLYTTFVGGSHNRDLAGAPTSILKQLVTSDLKKLLGVEGQPTFVKHVYWGNAFPLYGHDYSSVLEAIEKMEKNLPGFFYAGNSKDGLAVGSVIASGSKAADLAISYLESHTKHNNSH

SEQ ID NO: 26 - protein, 478 aa, Arabidopsis
MASGAVADHQIEAVSGKRVAVVGAGVSGLAAAYKLKSRGLNVTVFEADGRVGGKLRSVMQNGLIWDEGANTMTEAEPEVGSLLDDLGLREKQQFPISQKKRYIVRNGVPVMKKSSKVSDASAEESVSEFFQRHFGQEVVDYLIDPFVGGTSAADPDSLSMKHSFPDLWNVEKSFGSIIVGAIRTKFAAKGGKSRDTKSSPGTKKGSRGSFSFKGGMQILPDTLCKSLSHDEINLDSKVLSLSYNSGSRQENWSLSCVSHNETQRQNPHYDAVIMTAPLCNVKEMKVMKGGQPFQLNFLPEINYMPLSVLITTFTKEKVKRPLEGFGVLIPSKEQKHGFKTLGTLFSSMMFPDRSPSDVHLYTTFIGGSRNQELAKASTDELKQVVTSDLQRLLGVEGEPVSVNHYYWRKAFPLYDSSYDSVMEAIDKMENDLPGFFYAGNHRGGLSVGKSIASGCKAADLVISYLESCSNDKKPNDSL

SEQ ID NO: 27 - protein, 441 aa, Hydrogenobacter
MIDVAVVGAGISGLSIAYHLKKAGLEVKVFEKEDAVGGNIQTAYIDGYVCELGPQTILADSKVEEFLKDAGIKPIYANPSSKKRYIYRKGKLVALPLSPVEFLLSPFLSLGGKLRVLKEPFVPRSPKQEESIAEFVRRRFGREFLDYVVAPFVSGVYAGDPEELSVKYAVRKVYELEQKYGSVIKGAIKLKALGPSGKLISFEGGNATLIRKLSESLEVHKENVVLRIRRKDDIFILDTKEGKVTAKAVVVSTPATSTGYLLRDLSWSISEEFDKIYYAPVLVVHVAVKFGVLPEGFGFLVPKKENKRILGVIFSSNLFEGRSPEGKSLITVYIGGATDPEIIEYEDEAIVSVLERELRETVDIRDWDLLKITRWKKGIPQYTVGYGRYLELANSIEMEQPGLFLSGNYLYGVSVADCIRVSHHIAKRVIDFLEVKGRTVV

SEQ ID NO: 28 - protein, 458 aa, Thermovibrio
MRVCVIGGGVSGLSTAFYLKRGGAQVKLLERENYPGGKARTYYEKGYIVESGPNGFLDGKPDTLELVKLLGAEKLLYRSSDKARKRFIYKNGRLVRLPENPIAFLSSYLLSWKGKVRVLGELLVPPSEKEDETLAEFVRRRLGKEALDYLLDPMVAGIFAGDPERMSLKAAFPTIYRLEREYGGLIRGLIAKAKEAKKKGAKSSGPAGPGGVLTSFVKGMSQFTQLLAQELGESFTPEAQVKTLEKKKDKWLVTYTLRGKEKSEEFDAVVLSLPAYAAAQVLKETSRELSELLASIEYSPISVVALGFEKRGLGHNLDGFGFLVPKVEGRKILGALWDSSVFPNRAPEGKALIRVMIGGARQPELALKSEEELTEIALKELKRIMKIRHYPEMVKVFRHEKGIPHYTIGHAEKVERIFKLGRELGNLFFCNNAYKGVGINDCTKSARETAEEVLNSLC

SEQ ID NO: 29 - protein, 462 aa, Ignavibacterium
MTKTIVVIGAGISGLTTAYLLSKRGFNIRILERKSEVGGSIESIKENGFLFDRGPNSALETTPLISQLVEELNLKDELLYANKAANKRYILRNNELHALPMSPPALIKTKLFSAKAKLRLLTEPFIGRSEDGYYQSLAEFVRRRLGQEFLDYAINPFVAGVYAGKPEELSVKSAFPKLYALEEKFGGLIIGTIRSIRERKKRAEKSKQSARMLSFKSGMISLPKAIANYFADKLILSAEVISVDKTAEGFIVSYRHSGIDEAIVCDAVLSTVPSYVAGNLFSKFDKKFKVHSDEIYYPPVLVYFLAYEKKNIGQTLDGFGFLIPEKENKSFLGALWSSVIFPYRADNNFATFTLFIGGSRYPDFVKEDRNKLLEKVRKEFEQLMKIKSDPVFSAYRFWEKAIPQYNIGYIEHERFFDEFEKQNPGLFISGNFRGGISVGDCIKNAELVANKICVQFTMHNVQ

SEQ ID NO: 30 - protein, 544 aa, Sorghum
MLARTATVSSTSSHSHPYRPTSARSLRLRPVLAMAGSDDSRAAPARSVAVVGAGVSGLVAAYRLRKSGVNVTVFEAADRAGGKIRTNSEGGFLWDEGANTMTEGELEASRLIDDLGLQDKQQYPNSQHKRYIVKDGAPALIPSDPISLMKSSVLSTKSKIALFFEPFLYKKANTRNPGKVSDEHLSESVGSFFERHFGREVVDYLIDPFVAGTSAGDPESLSICHAFPALWNLERKYGSVVVGAILSKLTAKGDPVKTRRDSSAKRRNRRVSFSFHGGMQSLINALHNEVGDDNVKLGTEVLSLACTLDGAPAPGGWSISDDSKDASGKDLAKNQTFDAVIMTAPLSNVQRMKFTKGGAPFVLDFLPKVDYLPLSLMVTAFKKEDVKKPLEGFGVLIPYKEQQKHGLKTLGTLFSSMMFPDRAPDDQYLYTTFVGGSHNRDLAGAPTSILKQLVTSDLKKLLGVQGQPTFVKHIYWGNAFPLYGHDYNSVLEAIEKMEKNLPGFFYAGNNKDGLAVGSVIASGSKAADLAISYLESHTKHNNLH

SEQ ID NO: 31 - protein, 456 aa, Desulfurobacterium
MKVAVIGAGISGLSVAFYLKKGGAEVKVFEKEKTVGGKMKTIHEDGYIIETGPNGFLDGKPYTLNLVKELGIESKLYRSSDKARKRFIYTNGRLVRLPESPIAFLASYLLSWKGKLRLVGEFLVPPKKEDIDESLSEFAKRRIGEEALEKLLDPMVAGIFAGDPDRLSLKAAFPAIYYLEKQYGGLIKGLIAKMKEAKKSGKKSGPAGPGGVLTSFKGGVKDLIDSLSEFLGDSIETEVEILGLDRIEKGWKVKYKKENEVFEETFDAIVFSTPAYITAKLLNDLNLELSKLLSEIEYSPISVVALGFEKKGLGHDLDGFGFLVPRSEKRKILGALWDSSVFPNRAPSGKALIRVMIGGARQPELALLPDEELVNIALKELRRIMKIRHYPEKIKVFKHEKGIPHYTVGHAERVEKIFRLISKYPGLYLCNNAYTGVGVNDCTKAAEEVARRILDG

SEQ ID NO: 32 - protein, 446 aa, Acidithiobacillus
MEDVIIIGAGISGLATAYFLRKQGWSPLLLEAAAKPGGNLQSRQEEGYLRDMGPNSLMLKGHIVPEWLRELRLEEDIVEANPLAKRRYILNRHRQPVALGPGVLFGGGLLSWRGRLRLLGEPFRSPRRMQDSEESVADFVRRRLGEEALTWLVDPFISGVFAGNPARLSVQATLPRLIALEQDGGSLLRGALRARNKKSPDTPKTRLISFREGLQTLPLRVASALGDALRCNTPVEQLGNSDGSWQVSSGSQTWQSKRLILALPAGAAARLLAPTDAALAHELDAIPYPAVGSLSIGFQRMQVQHPLDGFGILIPRVMGLETLGILFSSTLFPGRAPADQVLLTAFIGGSQNDISGRDDDDLLATALREICPLLGISGKPVFSRCQTWPKAIPQYEIGHLDRIKRIDALSARHPGLYFRANWREGVALGDCMEEAYRFSQDVGWQR

SEQ ID NO: 33 - protein, 433 aa, Thermocrinis
MMDVIVVGAGISGLSVAFRLSKEGLKVKVLEKEEEPGGNIRTRKVGDFLCELGPQTVLADGEVVDFFREVGIQPQEASPSSSVRYIYKRGKLIPLPNSPVKFLTSPLLSLGGKLRVLMEPFVAPSVKTEETVAQFVRRRLGEEFLHYVITPFVRGVYAGDPEELSIKYAFRRVYQLEREYGSLIRAAIKLKRLGPPGKIISFEGGNQSIIQQLASYVDLETENVALRIRRKDDRYILDTKEGKYEARCVVVASPATSAGYLLRDISWSAAQELDKIYYAPVVVVHVATSQNIPDGFGFLAPQKEDLRILGVLFSSRIFPNKAPQGKELLTIYMGGATDPEVVEYEDELIMRIVEEDLRKSLGLTQLEFLLVTRWKRAIPQYTLGYGRYIELVEALQRENPGLFITGNYLEGVSVADCIKRSKRVVQEVVKFFR

SEQ ID NO: 34 - protein, 440 aa, Laribacter
MVVVIGAGISGLSCAWHLQQRGIPVVVLEAGSRVGGKIGTVAADGYRLELGPNTLYGHAGHLDLLERLGLTAAIRPAAAVVRHRFVLRGDRYEALPSGPLSFLTGSQFGARSKWLALTEPFRRNRPVREPETVAAFFRRRLGDEFVERAISPFVGGIFAGDPEELVAGLTLPVIHEAERQSGSIVRGMFARRKTFRRKATFTLNEGLQQLPETLAQGLDVRLDTSVQALERLETGWRVRTPAGELDADEVVLAVPADVAGQLLASHFPAIAANLANVTYAPVAVLHTAWPRSTVGHDLDGFGGLNPKVEKPFAAGSIWSGSLFPDRTPAGETLLTTFVGGMQFLDRYRHDDATLVALALEELRRLYRIQGEPTLCRLTRQEQAIPQYDSHALPLASAVSDLHEHGIRVCANWHGGVSVVDCLDKGQQVAVQCLLDYPPAS

SEQ ID NO: 35 - protein, 446 aa, Acidithiobacillus
MEEVIIIGGGISGLATAYFLRKRGWSPLLLEAGAAPGGNLQSRQEEGYLRDMGPNSLMLKGRIVPEWLRELQLEGDIVEANPLAGRRYVLNRHRQPVALGPGVLFGGGLLSIRGRLRLLGEPFQPPHPTPDGEESIADFVRRRLGDEALTWLVDPFVSGVFAGNPARLSVQATLPRLAALEQDGGSLLRGALRARKKKLPGTPKTRLVSFREGLQVLPLRVANTLGDTLRCDTPVDQLAYSGDMWQVGSGNQTWQSKRLVLALPAGAAARLLAQTDATLARELDAIPYPAVGSLSIGFRRPQVEHPLDGFGMLIPRVMGLETLGVLFSSTLFPGRAPAGQVLLTAFIGGSQNVLAGRDDDDLLATVLREIGPLLGISGDPVFSRCRVWPKAIPQYEIGHLDRMKRIDTLSAGHPGLHFRANWQGGVALGDCIEQAWEFSQTADWQH

SEQ ID NO: 36 - protein, 453 aa, Deferribacterde
MKIAIIGGGISGISTAFWLEYFAKERLKSIDITIFEKNKRLGGTINTFYKDNFIIESGPNGFLDSKPYTVETFEKAGLGDNLIRSNELAKKRYIMRGGVLHKLPEKPNEFFSSKLLSFKGKLRVISELFIPAKKDEYDETIEEFAYRRLGKEAADYLISPMVSGVFAGDPSKLSLKSCFPVIYNLEKEYGGLFKAMFKKKGKKSGPAGPGGNLTSYKGGLIKGINALTEQLSNTKIYLGEEVTGLDKTNGSFKVKTTNSCDNYDIVIITSPAYVAAEFIKGLSVELSDKLLKLNYAPMYVIGFGFKEEDVLDPLDGFGFLVPHNENRKILGALFTSSIFPERAPKGYKLIRVMIGGDKNRWVLNCSEDELRDIAFNEIKDILGVKGNSVVEKSFYWERAIPQYYQGHEKLVEDIESICMDINNIYIGGNLLYGIGINDCTKRSIDIARGVLGG

SEQ ID NO: 37 - protein, 471 aa, Geobacter
MKKAIVVGGGISGLASAYLLREKAKNSGMELEITIVEKEDRTGGKIRSIKEDGYLCEWGPNGFLDSKPQTLDLCRELKVDSQLLRSNDNARKRFIYSGGVLNRLPENGPSFLKSRLISWPGKLRLALEPTPFIAKAPEGVDETLAAFGRRRLGDEALRKLIAPMVSGIFAGDPETMSLVSCFPRIAELEREYGGLVKAMVKLAKKKKQEIAEGKQVASAAGPGGVLTSFRDGIQTLTDILNERLGKDMLVIGAEVTGVSRGNSTPYRVQTGGRELDADIVVLATPAYATAQALEGIDGGMSATLNQIPYATMTVVCFGYEQEKVAHDLNGFGYLIPKAEGMNILGTLWDSSIFENRAPEGKVLLRSMMGGACFPEYIRLSDAEVVQKVRDNLKTIMGIKEAPEFVRIFRHEKAIPQYTVGHGRRLAALEEQAKSHPGLFLSGNSYRGIGLNDCVAAANRTADEVVAFLQSR

SEQ ID NO: 38 - protein, 450 aa, Thermodesulfovibrio
MGSAEIVIVGGGISGLSLAYFLIQKNSQLNIKIVEAEKRAGGKIITENISGFLCEGGVNGFLSNKPSTISLAKELNIEPLRGSESSKIRYILIDGKLIRVPENPIKFFLTPLLSFSGKIRMLREYFTPPLKEEIDETVESFVSRRVGKEFYEKLIDAMSTGIYAGDPSKMSMKSCFPKVYWLEKRHGGLLKGLIALKKEKKDTKAQPSGVLMSFKGGMSELIQSLERHLSSRILKGKKVLSIDRKNTYYTVHLDDGNFIEAEKVILACPAHESAEILKELSSELSDILKTIPYPPLSVVAFGFKKEQIGFGTSLYGFLIPYREQRKILGTLFDSSIFPNRAPESYVLLRSMIGGRRAPELAMLPDEKLIDTALSELKPLLNIKGDPEFIKIFRWEKAIPQYELGHEDKLNRIEQILSEFSGLYLTGNAYRGVSVNDCIENSLKLAEGIMV

SEQ ID NO: 39 - protein, 469 aa, Geobacter
MKKAIVAGGGISGLATAYLLKTRAAEEGLELDVTLVEREERLGGKIWSIKEEGYLCEWGPNGFLDSKPQTLDLCRELGASDLLLRSNDNARKRFIYTGGALNRLPENGPMFLKSGLISWPGKLRLAMEPFIPKKAGDEDETLAAFGRRRLGDEALRKLIAPMVSGIFAGNPETMSLRSCFPRIAELEDEYGSLVRAMIRLAKKKKQEVAQGKAVASAAGPGGVLTSFRDGIQALTDILAERLGPDTIVSGQEVLEVSRGGSLPWRVRTGSIDMDADLVILATPAYATASIIQGVDSDMAGILRQIPYATMTVVCFGYDRERIAHDLNGFGYLIPKEEGMNTLGTLWDSSIFENRAPEGQVLLRSMMGGACFPEYVNLTDEEVTGRVKNDLATIMGITAPPSFVRIFRHHQAIPQYTVGHSTRVAALEQRAASLPGLFLTGNSYRGIGLNDCVAAANRTAGEAIAQLTSR

SEQ ID NO: 40 - protein, 469 aa, Geobacter
MKKAIVAGGGISGLATAYLLKTRAAEEGLELDVTLVEREERLGGKIWSIKEEGYLCEWGPNGFLDSKPQTLDLCRELGASDLLLRSNDNARKRFIYTGGALNRLPENGPMFLKSGLISWPGKLRLAMEPFIPKKAGDEDETLAAFGRRRLGDEALRKLIAPMVSGIFAGNPETMSLRSCFPRIAELEDEYGSLVRAMIRLAKKKKQEVAQGKAVASAAGPGGVLTSFRDGIQALTDILAERLGPDTIVSGQEVLEVSRGGSLPWRVRTGSIDMDADLVILATPAYATASIIQGVDSDMAGILRQIPYATMTVVCFGYDRERIAHDLNGFGYLIPKEEGMNTLGTLWDSSIFENRAPEGQVLLRSMMGGACFPEYVNLTDEEVTGRVKNDLATIMGITAPPSFVRIFRHHQAIPQYTVGHSTRVAALEQRAASLPGLFLTGNSYRGIGLNDCVAAANRTAGEAIAQVTSR

SEQ ID NO: 41 - protein, 436 aa, Aquifex
MDMREVVVIGAGISGLSTAYRLKKEGVDVVVYEKDDRIGGTIHTVKEKGYLFEVGAQTILADQEVIDFLKEAGIEPVEASPSSKYRYIYKKGRLIPLPMSPVEFLKTPLLSLKTKLKVLTEIFKRGVDEDISIADFVREHFGEEFLNYVVAPFISGVYAGDPEKLSLKHATPKLYEAQKKYGSLIKAFIKEKTAGPKGKLISFGEGLGELINALAQKLEVHTENVVLRMRKFEDFFRLDVRGKKVETKSVVVASPAYTSSYLLKEVSFSASEEFDKIDYPPVVVVNVGVEGKFPKVRLLSSESGKKRILGAMFMSKLFPGRAPQGKELLTVFLGGATDREVIELSEEEIENIVERELKEILQIDCIDFMHVQKWKRAIPQYTLGYDRFLNLAQEMEKDYPGLFLTGNWLYGVSTADCIRASKKVAQKVLSFLRPQA

SEQ ID NO: 42 - protein, 470 aa, Pelobacter
MNISVVGAGISGLATAFAIQQQARRLGLEWTLDIFEKEDCSGGKIRSEKVDGYLCEWGPNGFLDSKPMTLDLCREAGLAEQLLRSNDAARKRFIFSGGRLQRVPESAADFFRSSLVSWPGKLRLAAELLVPRRKDLTDETLADFVRRRLGREALDQMVGPMAAGIFAGDPETMSLRSCFPRIHELEQQYGGLIRALLLLARKKRAERRAGKAVAGAAGPGGILTSFGGGIQELTDGLSRLLAPNLHLGDAVAAITPLKEGFSLRTHKGRVHETDIVVAAVPAMALATQVEGFSAPMAAQLRQIPYAPLQIACFGYRREALPLSLDGFGYLAARRSGMHSLGTLWSSSIFPGRAPAGYVLLRTMFGGATRPDAAQLSADEVQQRVEEDLSRSMGIKQAPDFVRIIRHTAAIPQYVSGHGARLKVLEDKAAAYPGLFLVGNAFYGVGLNDCVAAADRVASRVLTLMQQRQQA

SEQ ID NO: 43 - protein, 469 aa, Geobacter
MKKVIVVGGGISGLATAFELRNKGAEAGIELDVTLLEKEERVGGKIWSIKEEGYLCEWGPNGFLDSKPQTLDLCRDLGASERLLRSNDNARKRFIYTGGVLNRLPENGPTFLKSSLISWPGKLRLAMEPFISKRTDGTDETLASFGRRRLGEEALQKLISPMVSGIFAGDPETMSLRSCFPRIAELEDEYGSLIKAMIKLAKKKKQEAAQGKAVSSAAGPGGVLTSFRWGIQELTDILAEQLGSATVVTGQPVTGLTRGSSVPWRLKTPTVDIDADVVILASPAHATAGIVSGVDAAMAQVLGEIPYASMTVVCFGFERERIAYDLNGFGYLIPKDEGMNTLGTLWDSSIFENRAPEGKVLLRSMLGGACFPEYVKLSDAEVMQRVKADLKATMGITADPSFIRIFRHPQAIPQYTVGHGKRLAALQERSSALPGLFLTGNSYRGIGLNDCATAANRTTDEVVAYLKGR

SEQ ID NO: 44 - protein, 435 aa, Cytophagahut
MIAIIGAGISGLTLAYQLQQAGKPYILFESNSRPGGYINSQRFGKYLLEVGPNSILVDKKLEEFIHELNLDKLFEPAAIINKNRFIYKDANIQQVPSGPLSFLTGRFFSAKTKYAIFKELFNKSISKENETVYDFFARRFSAPFTQYTIDPFATGVYAGDIKQLLIEETFPQLVELEKQYGSIIKGIFKKGFGEKRKTGTFVHGLQTLTDTLAAQLHSLQLNTRVLNLRKQMDKIVLTTDTKHGIEELTFDKVVVCGTTFQAATLIKDSYPDLSAILSQVQYASMKAVFAAFKRTDVTHPMNGFGCLYPSAEQSFLAGTIWNSSIFNDRCPADEVLTTSFIGGMHHPEYTALSESELEQRAIQQLSKDLGITGKPTFTHVAGWNKAIPQYDIYLKKARLASKLLSDDHIYFRSNWTNGISLGNCIQSARDLALIL

SEQ ID NO: 45 - protein, 471 aa, Geobacter
MKKAIIVGGGITGLATAWLLREKAKKAGMELEIALLEKEERVGGKIRSIKADGYLCEWGPNGFLDNKPQTLDLCRDLQADSQLLRSNDNARKRFIYSEGFLHQLPENGPSFFKSKLISWPGKLRLALEPTPFIAKAPDGVDETLAAFGRRRLGDEALRKLIAPMVSGIFAGDPETMSLQSCFPRIAELEREYGGLVMAMVKLAKKKKQELAEGKAVASAAGPGGILTSFRDGLQTLTEIIRGQLGCEVLSVGEEVVRIRKGSSVPYRVETTSRELDADVVVLATPAYATGQMLEGLDSAMTGILGQIPYATMSVVCLGYEQDKISHDLNGFGYLIPKGEGMNILGTLWDSSIFENRAPQGRVLLRSMMGGACFPEYIKLSDEEVQRRVCDNLKTIMGIAAPPDFVRIFRHEKAIPQYTVGHGKRLQALLDAGRNHQGLLLTGNSYRGIGLNDCVAAAVRSSNEVMEHLQKR

SEQ ID NO: 46 - protein, 465 aa, Porphyromona
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVATPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDHFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLRIPHTCKPDLLHISRHRHAIPQYYADTELRQDIIRRMEMRWPGLHLGGNMHGGIGMAHRISQGVEMARSIIEETAIAERSARG

SEQ ID NO: 47 - protein, 464 aa, Corallococcus
MTVAVIGGGITGLALAYQLRARGTDAVVLESTSRVGGNVQTHARGGYLLEAGPNSFLDREPTTRELADALGVSSRIRPADVAAKNRYVFTRGALRALPTSPPAFLKSDILPLASRLRVVGELFSGRNPTGADESLAQLGRRHLGREATAVLLDAMQTGTYAGDPEQLSAEATFPQLVKFEREHRSLILGAIRAQRAARQAKGAVETGPRLTGQMSTFDGGLGVLVDALAKALGDSVRTDAKVEGLERAADGWTVRYQQRGQPAELSASHVVLAVPAHVAASLVRPLDAELAQKADAIPYAPIAVVHLGFAPGTVPKPDGFGFLVPAVEGTAMLGTIHVSTTFPFRVEGGRVLLTCLMGGARRPEVVSRDEDALVALAREELKAMAGLTATPELTAVFRWPRGIPQYTVGHLERLAAMEERLKRWPGLHLAGNAYRGVGVNDCLKEAARLAEALGGPAAGATRSA

SEQ ID NO: 48 - protein, 454 aa, Calditerrivibrio
MRVAIIGGGISGISTAFLLENLKNELNLDMEITIIEKRLRWGGSIETSREDGFIVEAGPNGFLDSKPHTLELLSMAGLSNNLVKSNDLARKRYIMRNGILHRLPENPPMFFKTKLLSFSAKMRILSEYFIQKSVLEDESVADFARRRLGKEALEYLISPMVSGIFAGDPEKMSLRSCFPVIRDLEINYGGLFKGMIKKKGKKSGPSGPGGILTSYKNGLDNMITDLLESTSITKMLNTEVFSIDKKINRYILNTNKGIMEFDKIFINAPAYAVSQMLSVLDKDLSRDLNNITYPPVFVAGFIFKPEDLEDPLDGFGYLIPHSENKRILGALFDSSIFPDRTRDGYKIVRTIMGGDKNRWIIEKSDDELIRMAFDDIKETLKIKREPYKIKYFRWEKAIPQYYIGHHKIVEKVEEFYKKFDDIFIGGNILYGVGINDCTRTSFMNVDRFKNLLNK

SEQ ID NO: 49 - protein, 465 aa, Porphyromonas
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVGTPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDHFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 50 - protein, 454 aa, Stigmatella
MAVIAVVGGGITGLALAHRLRSRGKDAVVLEAGAHLGGVIQTRQRDGFSTETGPNSFLDREPATRELAASLGIEERIRMADPSAKSRSLYTRGQLRPVPASPPAFLKSDLLPLGTRLRVLAELFTGRAPPGQDESLGDFGRRHVGARATSVLLDAMQTGTYAGDVEALSAEAAFPTLKQLEREHRSLLLGAVRTQGRQRAPAPAGTKLKGAMCTFEGGLGTLVEALARALGPAARTGAAVEGLARSQNGWRLSVRERGQQAELEASQVVLTSPAHVSAELLAPLDPSLAGHLKGIPYAPIAVVHLGFAPGKTPPPDGFGFLVPGQEQRQLLGVIHVSTVFPFRAEGGRVLYTCLMGGARRPDLVGLNEEALAALAQQELREMAGVTASPDFTEAVRWPRGIPQYTVGHLERLSAIDSALARLPGLHLAGNAYKGVGLNDCIRNAAALAETLASR

SEQ ID NO: 51 - protein, 465 aa, Porphyromonas
MDHLTVIIGAGLTGLTTAAFLRAAGRPVLVLERAAHIGGQIRTYRENGFVFETGPNTGTISSPEVAELFELLGLEPEIATPAASNRLIWKGNKLYPLPRNIAEAVATPLFSLWDKWRILGEPFRRRGGQPNETVGALARRRLGKSFVDYAVDPFLGGIYAGDADQLVTRFALPKLYDLEQRYGSFVLGAVRKARQPQNERDRKASRKVFSVQGGLGLLVEALADYIGREHILTETQIRYINHPGAHTFGLTYTDASEEEHTIPCRHLVSTVAAHHIPTLFDRFPADESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 52 - protein, 462 aa, Leptospirillum
MSTVFRCDVLIVGGGISGLAAAMVLHQAGKNILLVESRGYLGGAIRSVEDSGYLLEMGPNSMMLGPEDPINVWLDKLGLSEKLLKASPEAQNRYVWCQGKLIPVPLSPSSFLTTPLFSLSEKMRVAKEFFISPGSGLPEGSDETVGHFVRRRLGNEFLEKLIDPFVKGVYASHPDLLSLNSAFPLLARLEQESGGLIRGAIRLSREKKRKKANLTGPPGGLYSFSGGLGEMVRAFSGYLKDESLIHGELIHWNRLPSGEFQCVLLQDEERVEVISQKMILATSPADAGRILEKNQPEIASVLSSIPMAPIAIAYIGVDRKALPGYLPGFGVLFPTSEKRKILGIIQNSDLFPNRSPDGKVLLTIFAGGMLSPKIAMSFDEDFEQIVLGELKTVFGLDSRPEFFRIQRWAEGISQYSPGHASRIQRIRDLTPEGMILTGNYLGGISVLKTFTNGLEAGKAFLS

SEQ ID NO: 53 - protein, 454 aa, Spirosoma
MTIGIIGAGISGLTLAYELQRRGIAYHLWEAAGQAGGYIRSQRDWPDGPSGRNYLRELGPNSLLGDAELLNWLDELGLTPELTFSQPVSKARFIFRDGKYRQLPSGPPSLLFGNFFSWKTKLAILRERNNKTVSPPGETLGQFFRRRFSSEIVDYALGPFVAGIYAGDPEQLLVSETFPSLLQYEKEYGSVLRGLIKSQSAGGSAIGRRQSFSFREGMQMLPNALAAKLTNLSLNEAVSSISPTPNGWEVETNTGTTTVDKLVLAVGTDAAARLVDQRYPDLARTLQAITYPPMTAVHSAYKRADVRHPLNGFGGLNPAVEGRFAAGHIWSSSIFTGRCPDDEVLFTTFVGGQTGAHNTRHPDSVLAHNVHKELVDGFGITAATPVYQSVFRWERAIPQYDATLASAKESVKAMEADQLFVCANWYGGVSLSDCIGKSRKLADQLAVKPFIKNF

SEQ ID NO: 54 - protein, 495 aa, Candidatus
MATEQHSGSRRIVVVGSGIAGLAAAYRLQERCEQDGPPCEVRVLEAAARPGGAISTTHRDGFVLESGPDTIFTDKPWGLDLIRRLGLSEQVIGTNEAHRRTFVVRDGALHPLPEGFALMGPTKPWPFLQSGLLSWRGKARAALDLVLPRGGPSDDESLASFVRRRFGQEFLDRLAQPMIGGIYGADPERLSLRATFPQFLQMEATHRSVILGLRRMRPAGRGVGHTSSGPRYGLFVTLDHGLQALVDAMVKRLPAGTLRLRAPVDRIAHTEQGWTVRLGDGASLQADGLILAVPAFEIARLTHDLDQDLARQLEAMPYASSVTINLAYRREAIHHPLDGFGFVVPACEGRTIIACSFSSVKFAHRAPAGHVLLRAFAGGALQPEPFTWDDETLLSAVRRDLEELLAIHAPPLWSQLVRHPRVMPQYQVGHLGRLAALEETLRRWPTLKLTGNAYRGVGVPDVVHSGETAADSLLAELAPSPTEPTPACTEGDSRL

SEQ ID NO: 55 - protein, 469 aa, Pelobacter
MKRAIIVGGGISGLATAWLLREKALACGIQLELVLLEKDQRPGGKIRSIHEGGYVCEWGPNGFLDSKPQTLELCDAVGVSSDLLRSNDNARKRFIYSDGELHRLPEGGGTFLKSRLISWPGKLRLALEPTPFIARTPAGVDESLADFARRRLGGEALDKLISPMVSGIFAGDPETMSLVSCFPRIAQLEREYGGLIRAMVRLARQKKRERAAGKAVSSAAGPGGVLTSFRPGIQYLTDSLAASLGGIVMADREVSWVRRGKSAAWRVGCRDGGEYDADLVIVASPAHAASAILHDCDAGIASILESIPYASMTVVCLGYERELVSHPLDGFGYLIPKKEGRSILGTLWDSSMFENRAPTGKVLLRSMVGGACFPDYVHMGDDELLGRVRGDMKDVMGIVAEPSFIRIFRHPQAIPQYTVGHGERLKHLEERLACHPGLILTGNSYRGIGLNDCVAAAQRASDQALELLR

SEQ ID NO: 56 - protein, 436 aa, Aquifex; identical to SEQ ID NO: 41

SEQ ID NO: 57 - protein, 495 aa, Candidatus; identical to SEQ ID NO: 54

SEQ ID NO: 58 - protein, 457 aa, Artificial Sequence
  Synthetic Polypeptide
MGVEVAIIGAGISGLSVAFFLKRAGAGVLVLEAEEDVGGTMRSRRFKGYLIELGPNSALETTPLFQELIAAAGLAGERVYASEAARNRYIVRGGELHPLPLTPLAFLRSRLWSWKGKLRVLAEPFHGRADREESVADFARRRVGQEFLDYAVNPFVAGIYAGDPERLSVRFAFPRLYALEAQYGGLFLGMLRGARERRRRGEAPKIAARLFSFREGMGALPRALAAALGNTVWCATRALCVERAGAAFEIAFERDGRRDTLRAERVVLATPAYAAASLLKRLAPEAARALDRIVYPPVSAVILGYPETAIGRPLDGFGFLVPEKEQRRILGTIWNSTIFPARAPQGFVTLTTFVGGMRQPELARRPNEELIALVAEELTDLLRLRGEPEFAYVSRWERAIPQYELGYGEILDALDRAEREHVGLYFCANYRGGIAVGDCVMSAHATAERILRDRARS

SEQ ID NO: 59 - protein, 462 aa, Artificial Sequence
  Synthetic Polypeptide
MAGFDCDTLVVGGGVSGLAAALTLKNRGVDVRLLESRGYLGGAIRTVREDGYLLEFGPNSLMVRPEDAIDTVLGDPELRARIVPASGLSKNRYVVKAGHLYPVPLSPWAFFRTPLLSWRGRRDILSEWKVPPRTGGPEETLSHFVRRRLGEEALDYFVDPFVKGVYASHPDLLSVEAAFPLLVRLEREHGGLLRGALKTFLKRRKRPSGSSPRGIFSFAGGMTDLVEAMGKRLGEDVGTNVDVIKYTRLEEGFRVALMYDETEYYMTSRRLILATSAPQAAELLEGDPDGPSSELKSIPYAPVTIAYAGFLREQVTHPLDGFGLLCPTVENRKVLGVIFSSSLFPGRAPEGKVLLTVFVGGMTGQKLAQAFDEDLERIVLKELTELLGVKGAPSFFRIHRWEKAIPQLILGHGETVRTIRKKLPSGLRLAGNYLDGISIARAFASGVRAAEELLSEDGGTPG

SEQ ID NO: 60 - protein, 467 aa, Artificial Sequence
  Synthetic Polypeptide
GCAAAYKLKLHGLNVTVFEADERVGGKLRSVSQDGLIWDEGANTMTESEADVSSLIDDLGLRDKQQFPISQHKRYIVRNGKPVLIPSNPIALIRSSFLSTQSKVQILLEPFLWKKTKSSDEPESVGGFFQRHFGKEVVEYLIDPVVAGTSGGDPESLSMRHAFPELWDLERRFGSIISGAFQSMVSSRGGKRKPSGNSKRRRGSFSFFGGMQTLTDALSKEIGPHEINLQSKVLEMSYSCDDNAVGNWSIYCAPDQNKQFQQSFDAVIMTAPLNNLKEMKITKTGSPFLLNFIPEVSYLPISVIISTFKKENVKQPLEGFGVLVPAKEQENGLRTLGTLFSSMMFPDRASEDVYLYTTFVGGSRNKELAKASRDELKQIVTSDLRQLLGTEGEPKFLTHYYWSKAFPLYGRDYGSVIEAIEKMEKELPGYFYAGNHKGGLSVGKAISSGCKAAESVIAYLDSYSNQK

SEQ ID NO: 61 - protein, 535 aa, Amaranthus
MVIQSITHLSPKLALPSPLSVSTKNYPVAVMGNISEREEPTSAKRVAVVGAGVSGLAAAYKLKSHGLNVTLFEADSRAGGKLKTVKKDGFIWDEGANTMTESEAEVSSLIDDLGLREKQQLPISQNKRYIARDGLPVLLPSNPAALLSSNILSAKSKLQIMLEPFLWRKRNATELSDEHVQESVGEFFERHFGKEFVDYVIDPFVAGTCGGDPQSLSVHHTFPDVWNVEKRFGSVFAGLIQSTLLSKKEKGGGENASIKKPRVRGSFSFHGGMQTLVDTMCKQIGEDELKLQCEVLSLSYNQKGIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLAKASTDELKQIVSSDLQQLLGTEDEPSFVNHLFWSNAFPLYGHNYDSVLRAIDKMEKDLPGFFYAGNHKGGLSVGKAMASGCKAAELVISYLDSHLYVKMNEKTA

SEQ ID NO: 62 - protein, 493 aa, Silene
TSDPDKLQSSAKRVAVIGAGVSGLAAAYKLKSNGLNVTLIEADERAGGKIRSAAKNGYIWDEGANTMTESESEVTSLLDDLGIRDKQQLPLSQNKRYVVRDGLPVLLPSGPISIFTSNFLSPKSKLRLLCEPFSWRRRDNAKVSDEQADESVSDFFGRHFGEEFVDYLIDPFVGGTSAADPKTISMRHSFPELWDIEDRFGSIIAGAIQSRLTPKPGEQKKPVKKTRVRGSFSFKGGMQTLVDTICERFSEDELKLKCKVLSLSYSHEGHSNNWSLSCLSNKSIEDRPYDAVVVTAPLTNVKDMKILNGGSPFSLDFVPEVDYLPVSIIVTAFKKANVERPLEGFGVLIPSKEQEKGLKTLGTLFSSMMFPDRSPADQYLYTTFVGGSRNRELARATTDELKQVVLSDLQQLLGVKGDPSFINHVYWSKAFPRYGQNYESVKMAIAKMENDLPGFFYAGNHKDGLSVGKALASGYKAADLVMSYLNSYSNTNQ

SEQ ID NO: 63 - protein, 493 aa, Silene
TSDPDKLQSSAKRVAVIGAGVSGLAAAYKLKSNGLNVTLIEADERAGGKIRSAAKNGYIWDEGANTMTESESEVTSLLDDLGIRDKQQLPLSQNKRYVVRDGLPVLLPSGPISIFTSNFLSAKSKLRLLCEPFSWRRRDNAKVSDEQADESVSDFFGRHFGEEFVDYLIDPFVGGTSAADPKTISMRHSFPELWDIEDRFGSIIAGAIQSRLTPKPGEQKKPVKKTRVCGSFSFKGGMQTLVDTICERFSEDELKLKCKVLSLSYSHEGHSNNWSLSCLSNKSIEDRPYDAVVVTAPLTNVKDMKILNGGSPFSLDFVPEVDYLPVSIIVTAFKKANVERPLEGFGVLIPSKEQEKGLKTLGTLFSSMMFPDRSPADQYLYTTFIGGSRNRELARATTDELKQVVLSDLQQLLGVKGDPSFINHVYWSKAFPRYGQNYESVKMAIAKMENDLPGFFYAGNHKDGLSVGKALASGYKAADLVMSYLNSYSNTNQ

SEQ ID NO: 64 - protein, 501 aa, Solanum
MAPSAGEDKQKRVAVIGAGVSGLAAAYKLKVHGLNVTVFEAEGRAGGKLRSLSQDGLIWDEGANTMTESEGDVTFLLDSLGLREKQQFPLSQNKRYIARNGTPTLIPSNPFDLFKSNFLSTGSKLQMLFEPLLWKNKKLTKVSDKHESVSGFFQRHFGKEVVDYLIDPFVAGTCGGDPDSLSMHLSFPDLWNLEKRFGSVIVGAIQSKLSPIKEKKQGPPRTSINKKRQRGSFSFLGGMQTLTDAICKNLKEDELRLNSRVLELSCSCSGDSAIDSWSIFSASPHKRQAEEESFDAVIMTAPLCDVKSMKIAKRGNPFLLNFIPEVDYVPLSVVITTFKKESVKHPLEGFGVLVPSQEQKHGLKTLGTLFSSMMFPDRAPNNVYLYTTFVGGSRNRELAKASRTELKEIVTSDLKQLLGAEGEPTYVNHLCWSKAFPLYGHNYDSVLDAIDKMEKSLPGLFYAGNHKGGLSVGKALSSGCNAADLVISYLEAVSADTKNHS

SEQ ID NO: 65 - protein, 463 aa, Artificial Sequence
  Synthetic Polypeptide
MATEDVETLVIGGGIAGLACASHLKLAGRTVRLVERNDYLGGVIRTLSDSGYRIETGPNSLLVRTEEPLLKYLSRPEIAARIQLAGRMGKKRFILKDGHPVALPMSLSEGIFTQILSLPAKVRLLKEPFIPPAGGVDGVDPEKETVADFVRRRLGNEFLESLIDPFVKGVYASDPHLLSMADTFPRLVQMEKSYGSLIKGGLALARQKKAPAPAFAREILSFSEGMGTLPESLANILDDDAGTNAEVIGCAPSESGFRTALLFEEETYYIRSKHLVLALPAAQTAELIEPMAPGIPSLLGQIPYAPIAVVYLGYPRDRISHPLDGFGLLVPSRERRKILGALFSSSLFPGRSPDGHVLLTVFVGGMTQPKLAQAFDEDLLPMVTKEIGSMLGVLGAPSYVRIQRWAGAIPQSVPGHGERIRSIESALPSGLHLAGSYLSGVSVSQTFSSGIRAAEKILAQSPG

SEQ ID NO: 66 - protein, 544 aa, Zea
MLALTASASSASSHPYRHASAHTRRPRLRAVLAMAGSDDPRAAPARSVAVVGAGVSGLAAAYRLRQSGVNVTVFEAADRAGGKIRTNSEGGFVWDEGANTMTEGEWEASRLIDDLGLQDKQQYPNSQHKRYIVKDGAPALIPSDPISLMKSSVLSTKSKIALFFEPFLYKKANTRNSGKVSEEHLSESVGSFCERHFGREVVDYFVDPFVAGTSAGDPESLSIRHAFPALWNLERKYGSVIVGAILSKLAAKGDPVKTRHDSSGKRRNRRVSFSFHGGMQSLINALHNEVGDDNVKLGTEVLSLACTFDGVPALGRWSISVDSKDSGDKDLASNQTFDAVIMTAPLSNVRRMKFTKGGAPVVLDFLPKMDYLPLSLMVTAFKKDDVKKPLEGFGVLIPYKEQQKHGLKTLGTLFSSMMFPDRAPDDQYLYTTFVGGSHNRDLAGAPTSILKQLVTSDLKKLLGVEGQPTFVKHVYWGNAFPLYGHDYSSVLEAIEKMEKNLPGFFYAGNNKDGLAVGSVIASGSKAADLAISYLESHTKHNNSH

SEQ ID NO: 67 - protein, 507 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVASFFERHFGKEVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGVLIPYKEQQKHGLKTLGTLFSSMMFPDRAPNDQYLYTSFIGGSHNRDLAGAPTAVLKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 68 - protein, 542 aa, Setaria
MLSSSTTTASPASSHPYRPAYPRASLRPVLAMAGSDDPRAAPARSVAVIGAGVSGLAAAYRLRKSGVNVTVFEAADRAGGKIRTNSEAGFLWDEGANTMTEGELEVSRLIDDLGLQDRQQYPNSQHKRYIVKDGAPALIPADPISLMKSSVLSTKSKLALFLEPFLYKKSNTRNSGKVSDEHLSESVGSFFERHFGREVVDYLIDPFVAGTSAGDPESLSIRHAFPALWNLERKYHSIIVGAILSKLTAKGDPVKTGSDLSGKRRNRRASFSFHGGMQSLINALHNEVGDDNVKLGTEVLSLACTFDGLPSTGGWSISVDSKDAGSKDLAKNQTFDAVIMTAPLSNVQRMKFRKGGAPFVLDFLPKVNYLPLSLMVTAFKKEDVKKPLEGFGVLIPYKEQQKHGLKTLGTLFSSMMFPDRAPDDQYLYTTFVGGSHNRDLAGAPTSILKQLVTSDLKKLLGVEGQPTFVKHIYWRNAFPLYGRDYGSVLDAIEKMEKNLPGFFYAGNNKDGLAVGNVIASGSKAAELAISYLESQTKHNNSH

SEQ ID NO: 69 - protein, 507 aa, Brachypodium
MAASDDPRAAPARSVAVVGAGVSGLVAAHRLRKSGVRVTVFEADDRAGGKIRTNSDSGFLWDEGANTMTESALEASRLIDDLGLQDKQQYPNSQHKRYTVKDGAPTLIPSDPIALMKSTVLSTKSKFKLFLEPFLYEKSHTRNSQKVSDNHLSESVGSFFERHFGKEVVDYLIDPFVAGTSAGDPESLSIRHAFPGLWDLEKKYGSIIVGAILSKLTAKGDSTKKADTSSGKGRNKQASFSFHGGMQTLVEGLHKDVGDGNVKLGTQVLSLACSCDRLSASDGWSISVNSKDASSKLAAKNQLFDAVIMTAPLSNVQRMKFTKGGVPFVLDFLPKVDYLPLSLMVTAFRKEDVKRPLEGFGVLIPYKEQQKYGLKTLGTLFSSMMFPDRAPNDQHLFTTFVGGSHNRDLAAAPTAILKQLVTSDLRKLLGVEGQPTFVKHVHWKNAFPLYGHDYDLALEAIGKMENELPGFFYAGNNKDGLAVGNVIASGSKTADLVISYLESHQAR

SEQ ID NO: 70 - protein, 551 aa, Oryza
MLSPAATTTTTTSYCSYSSRAHAPTRSASAGAARFRPARAMATSDNDPRGAAPARSVAVVGAGVSGLAAAYKLRKRGVQVTVFEAADRAGGKIRTNSESGFIWDEGANTMTESESEAGRLIDDLDLQGKLQYPNSQHKRYIVKDGAPTLIPSDPIGLMKSTVLSTKSKLKLFLEPFLYEKSSKRNSGKVSDEHLSESVASFFERHFGKEVVDYLIDPFVAGTSGGDPESLSIRHAFPALWNLENKYGSVIAGAILSKLSTKGESVKTGGATPGKGRNKRVSFSFHGGMQSLIDALHNEVGDGNVKLGTEVLSLACSCDEISSSGGWSIAVDSRDAKGKDLRKNQSFDAVIMTAPLSNVQRMKFTKNGAPFVLDFLPKVDYLPLSLMVTAFKKEDVKRPLEGFGVLIPYKEQQKHGLKTLGTLFSSMMFPNRAPNDQYLYTSFIGGSHNRDLAGASTAILKQLVTSDLRKLLGIEGQPTFVKHVHWGNAFPLYGRNYDLVLEAIAKMEKNLPGFFYAGNNKDGLAVGNVIASGSKAAELVLSYLESHTDQDN

SEQ ID NO: 71 - protein, 494 aa, Picris
MAEHIHTDQNDKRPLKSVAVVGAGISGLAAAYRLKSQGLAVTIFEADGTTGGKIKSFAQNGLIWEKGANTMTETEPEVGKLIDDLGIRGKQQFPIMQSKRYIVRDGKPQLLPSNPVAFIGSKTLSAQAKLNIFLEPILWKHKNSKEKTPNSPDIYQEESVGDFFRRHFGQEVVDYIVDPFVAGTAGADAESLSIRHMFPEIWDLEERFGSIITGAIKSSWSRKKAQRDAKHVTHGQKRQRGSFSFMGGLQTLTNALSKKLGEESLRMHCSVLSLSCNLQGNPPHNNWSVCYARNDASYKEPLKEQSFDAVVMTVTYLPMSIIITTFKKQDVKHPLEGFGILVPSKEEKNGFQTLGTLFSSNMFPDRAPTDQYLFTTFIGGNRNRKLAKSQLKDLQEVAVNDLNKILGVGSDPLSVKHIYWNEAFPLYSLDYNSVVAAIDKLGKSLPGIYFAGNYRGGLSVGKALTSGFKAADLAISDFNSKGLCTMIGTDHEVK

SEQ ID NO: 72 - protein, 506 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESVIFLCICRDNQVVDYLIDPFVAGTSGGDPESLSIRHAFPALWNLENKYGSVIAGAILSKLSTKGDSVKTGGASPGKGRNKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGNNKDGLAVGNVIASGSKAADLVISYLESCTDQDN

SEQ ID NO: 73 - protein, 465 aa, Artificial Sequence
  Synthetic Polypeptide
MDHLTVIIGAGLTGLTTAAFLRAAGRPVLVLERAAHIGGQIRTYREDGFVFETGPNTGTISSPEVAELFELLGLEPEIATPAASNRLIWKGNKLYPLPRNIAEAVGTPLFSLWDKWRILGEPFRRRGGQPNETVGALARRRLGKSFVDYAVDPFLGGIYAGDPDQLVTRFALPKLYDLEQRYGSFVLGAVRKARQPQSERDRKASRKVFSVQGGLGLLVEALADYIGREHILTETQIRYINHPGAHTFGLTYTDASEEEHTIPCRHLVSTVAAHHIPTLFDRFPANESAVFEQLYYAPMIEVAVGFRRNVATHLPAFGCLIPSRENRRILGILFPSDCFRGRAPEGGALYSIFMGGVRNASLIDLSDEEISTIAMEELRDMLHIPHTCKPDLLHISRHRHAIPQYYADTELRQDIIRRMEMRWPGLHLGGNMHGGIGMAHRISQGVEMARSIIEETAIAERSARG

SEQ ID NO: 74 - protein, 505 aa, Oryza
MAASDDPRGGRSVAVVGAGVSGLAAAYRLRKRGVQVTVFEAADRAGGKIRTNSEGGFIWDEGANTMTESELEASRLIDDLGLQGKQQYPNSQHKRYIVKDGAPTLIPSDPIALMKSTVLSTKSKLKLFLEPFLYEKSSRRTSGKVSDEHLSESMFSDQREYICSVIFLCICRDNQVVDYLIDPFVAGTSGGDPESLSIRHAFPALWNLENKYGSVIAGAILSKLSTKGDSVKTGGASPGKGRDKRVSFSFHGGMQSLIDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGKSMKAPLLYKRNLRYLKHIPVD

SEQ ID NO: 75 - protein, 461 aa, Salinibacter; identical to SEQ ID NO: 2

SEQ ID NO: 76 - protein, 469 aa, Rhodothermus; identical to SEQ ID NO: 3

SEQ ID NO: 77 - protein, 483 aa, Tribolium
NMSLRLVLFLVFCIGKVLGNFSVIVIGAGPSGIAAATKLLQHSVNVTVLEAENRIGGRINTVKFGDGLVELGAEYCHGEVGNIVKELVNGYDLLEPNFNYLNGEIYYSNGSKLDHGFVREMQDLILSENKEENYDTRGKSIGEVFMHKYNSTLVEKYKSDENKLKLLKEGLHFAERSILISEGSFSWFDASADSDWLECPGNQTLVWKGVGYKTVLEILMKSYPNPDEKLPLDDKLFLNSKVTKINWGEKPIKVHTSDKVYSADYVIFTPSIGVLKAGSDLFTPSLPPKKHKAIDSIGFAGVVKLFLRFPVKWWDDNDKYFAFFWSDDDLKSENFPEGPPEKRKIVGYPAVGLVPSWAQHQRLDDLDLGEMVPEIEQLPIETLKKGVNFTLEKFLGKDYNITEIGEVLRSGWVTNENFRGTYSFTRNGLYQKGVSYQNDLAEPLEGLFFAGEATNPVHFATVHGAIESGHREARRILDPRNKN

SEQ ID NO: 78 - protein, 453 aa, Tribolium
SVIIVGAGVSGISAAVKLFENGIANLKIFEAEDRIGGRIHTVKFGDNFIDLGAQYCHGENVVYDTVKDLDLLEHAQLFSTPKMYYSNGSHLDNQLTQDLQKVVSSYDHDITRSKELSLGDAFLKKYNSTILEKYKNDPENFKLASDGLTFAHSTILMHEGAFHWSRPASGRHYKAVKGDQMMVWKQRGYDMILDVLLKRYPDPSLKIPIEEKLFLNKRVTKITWTGDKASVKLSDGTSHEADHVIFTPSVGVLTHDDLFEPVVPPRKQQAIKSMGFDGIIKLILYFPEKWWHDSDSTFFFLWDRKDLEGITKEFNEGPSKDGISWVSNLVALVKVPSNPHVLIGWVSGGLIPEMEKMSLDVVKKGSMFVIRKFLGRDYNVTEPGEVLWSDWHNNPNFRGTYSYEKNGYFEEEVHYQDHLAEPLTQGTTPVVLFAGEATHPTHYSTVHGAIESG

SEQ ID NO: 79 - protein, 612 aa, Mycosphaerella
MASSSSPNHGKKAIVIGAGVGGVSTAARLAAAGFSVTVLEKNSFTGGRCSLIHHDGYRFDQGPSLLLLPHLFHATFADLGTTLEKEGVHLLKCEPNYNIHFGDGEKFTLSTDLSVMKEEIEKWEGKDGYDRYLAFLRESHAHYELSVTHVLLKNFTSLLSMLRISFLQHLVALHPFESIWSRASRYFWTERLRRVFTFGSMYMGMSPFDAPGTYSLLQYTELAEGIWYPVGGFHKVVGALVGIAERMGAEFRLETAVKRICVTADGARATGVELENGEVLEADVVVNNSDLVYAYNHLLQPQAYAESLSDRPGSCSSISFYWALDRKVPELSAHNIFLADDYRESFDSIFKKHLIPDQPSFYVNVPSRVDSTAAPEGKDTVVVLVPVGHLTGEAAASHFSQPASSPSKPNGGTIKSASPSTQTGIPPTLDQDWPAMIALARQTIIKTIHHRTGVDLHPLIIHEQSNDPVTWRSAFNLDKGAILGLSHSFFNVLCFRPSTRARRAGPLDPLLKYLSGLYMVGASAHPGTGVPIVLAGGKLVAEQVCGDMGVRVPWVVEEGRGKGKEEVKKLDRMEKPETWVKWVGILIALGMVPWILGWVVVLFLAKVASVGW

SEQ ID NO: 80 - protein, 936 aa, Mycosphaerella
MSIDTEEATCQVPVELSAGSESEEELNDIAEHELEDDFDPHFHREGQATPMVDIAGPASESQHQQPPAFSRWVSKLRRKRHNHPQLLSPRKERWTLDDFDTRAASPGQQYLSPGRHYHSDSQGSSVRFVTAVRSATATLASASMATLSRRTTRFRRGHQRSSIVSGSEIRLSIESRRSIIDEAAKQRARKRREKLEELIRTEESYVADVKALSNAYFTILAHQPTATSFARTSTQRTIADILHLHDDILGCLHRIVPFAEYDQTIARLPLPLRAHNRWHSMDAVPQRTTPNRSTLATIRQGRRSLNISRSSSDDAQVVLRCSPQTIAAVAKAFSDNMLRFAAYEDYGANYDLIQRDVDDTQRAISGWADFDKAIEAISAHVNPMRTREANRKRAMTVKDLLIKPIQRLPRYELLFSDLHKLTPACDDPISHAEIEELRLKLNSVCHRMNAAKENPARARALEMTWLIGDRLTFSSQVPRSIFLQLLGRVSLCGSLYIAYRSRDRIKGAYVICVLFESCLLLASCDEDQSKYSILVSITLANATIEETDNAKGLQCHTAPHAWKVVFEQGARMYELIFTACSAVESEVWRTHIASGIETQIAAVAEGKANVFELQSPLTADMKSIGKAFGKPGSFVRRMSVQRAATIGPTADLNQVIIKNTQAVKEVMDNSSQGSFQIPRSQSVATPSHVQTLAPRRADRHRLETILSDVWSRDLLPYPGMVRRSDPIRAGANHVIRKFSMASITSNFSSSKRTGSYTSMSSWRKEDMPPPRNRGESGREGSSMSSRQSRPPLIDFHTAPDAFLPADFEIGRPSKDKRKRSALRTFTMTMERPFTPLLGNENKQSGLRRAQSVKDVVDDQARPGPSPIQLKRREEKRTGTPVYSVVQERARTPAMLHVKDESLEMGMGVGEASNGAVAGKAPRKSKSRLLRLFGQER

SEQ ID NO: 81 - protein, 573 aa, Mycosphaerella
MLHSRSCTYRLLAPAVARRITPLVPSQCLLQTHRSRTYSAEAAPSHDVAVLGGGITGLAAAHYVTREHPRAKVTLYEASDRVGGWVSSKRADVHDGTVLFEGGPRTLRPNGNGVLAANASQMQELDLTKDAIFTQKSSPAAQNRFVYYPDHIVRMPHPSAGLFNNLWSLMTEPVFATALKSGFMEAFTTGRDGSIQDESIAEFFSRRLSPTMVDRILSAVIHGIYAGDVNKLSAKSLFPNQWRHEAKYDSLIKGVIQERAEGTMVTKREADFLQAMKVFEWDPLLKATLKDNSVFTFKDGLQMLPDRLHSRLFEDGRVEFKTGSPVESIVQSQGNSGIQVTTKGSTESKTHTHVISALSPEHLNTVCRHGSASSRLIDSIPTVTVMTVSMYFRTPDLHEPGFGYLIPQATPFENNPERALGVVFDTAYSPGSSDSRGTKVTVMLGGHWWDGWPAFPDEEEGVTMARAVLERHLGIKEAPEAWQVNLQADCIPQYTVGHETRLKKAHNNIWQEYKGRLRVAGNWMSGVGVNDCLRSAYEVARNLSKDGTGLQHVGEAPTLRMKPVRPGEKTEES

SEQ ID NO: 82 - protein, 239 aa, Apisum
KREGGIEKNQSIQIIEASDHTGGWIQSWKDENTNVISELGPRTIRGRGKSANNTYSLIKDLGIEDLVRNVGIDASARYIFANGNIHQLPMSVWKALFTVNQPFTKPWIYYVLRECFSSNNSKDKLSDVQNNDESAYDFFCRTFGQEFADYLISPLLCGVCGGNAKQMSVKFMFGALYEAERKHGTVGLGLLKEQLSSIWNREKVKDTKGTNTVKPPPSVYYLDGGLQRLIHALDIENES

SEQ ID NO: 83 - protein, 502 aa, Schizophyllum
MAPHHIAVLGGGLTGLSSAYHLSHRFPNALITLVERSTRVGGWAESERVSLKDPKDGSEASILIEGGPRTLRPTAKSVLELVTRLDLLDDLILVPRTSPSAKNKYFHMPGQPGLLAVPSSFKGLISSPLGACLTRAVAKEAMAFSNRDDLKDESFDSFLCRRFTAEFAEKVGSALVHGIFAADSRKLSVRAAFPVLWEAEEYGWGSVVRGFIRGRREEDVEESYYISNPVQKAMEETAVFSFRNGMDTVARATEHHLSKLKNVTILKGADVKSLGVNSKDKSIEVQIRPTHVVSTLPLPALHRVLTPTSNLPHLTTNPYSTVTVYNLIFRTDTPTPIHPAGFGYLIPRPPGGYEQPQANKEGILGCVFDSCALSAQDVMPGPTKYTKMTVMTGGPYQNKPPALDTVLQALARHLDWPEVYEPVYTRVRENRDCIPVPAPGHLERVAELRRVLKEGEWQGRMEVVGAGVGGVSVGDCVEAGRWVGEGWGPSTPQMEDDECDDE

SEQ ID NO: 84 - protein, 150 aa, Acinetobacter
MDAPSDAFLWVKALHIIAVVCWFAALFYLPRLYVYHAMSEDDTSHRRFEVMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 85 - protein, 150 aa, Acinetobacter
MDAPSDAFLWVKALHIIAVVCWFAALFYLPRLYVYHAMSEDEISHRRFEIMERKLYRGIMWPSMIATLITAHFLVDWGDATRHYHEALWFYIKVGLVGLLVIYHFVCGYYRKKLIGNAHYKSHKFWRYFNEMPTLILFAVVILVVVKPQF

SEQ ID NO: 86 - protein, 150 aa, Acinetobacter
MDAPSDAFLWVKALHIIAVVCWFAALFYLPRLYVYHAMSEDEISHRRFEIMERKLYRGIMWPSMIATLITAHFLVDWGDATRHYHQALWFYIKVGLVGLLVIYHFVCGYYRKKLIGNAHYKSHKFWRYFNEMPTLILFAVVILVVVKPQF

SEQ ID NO: 87 - protein, 150 aa, Acinetobacter
MDAPSDAFLWVKALHIIAVVCWFAALFYLPRLYVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 88 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 89 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGMVGLLVIYHFVCGYYRKKLIGNAHYKSHKFWRFFNEMPTLILFAVVILVVVKPQF

SEQ ID NO: 90 - protein, 150 aa, Acinetobacter
MDAPSDAFLWVKALHIIAVVCWFAALFYLPRLYVYHAMSEDVVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 91 - protein, 150 aa, Acinetobacter
MDAPSDAFLWVKALHIIAVVCWFAALFYLPRLFVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 92 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDASRHYHEALWFYLKVGLVGLLVIYHFVCGYYRKKLIGNAHYKSHKFWRFFNEMPTLILFAVVILVVVKPQF

SEQ ID NO: 93 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPQF

SEQ ID NO: 94 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDATRHYHEALWFYLKVGLVGLLVIYHFICGYYRKKLIGNAHYKSHKFWRFFNEMPTLILFAVVILVVVKPQF

SEQ ID NO: 95 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKSHKFWRFFNEMPTLILFAVVILVVVKPQF

SEQ ID NO: 96 - protein, 150 aa, Acinetobacter
MDAPSDAFLWVKALHIIAVVCWFAALFYLPRLFVYHAMSEDAVSHQRFEVMERKLYRGIMWPSMIATLITAHFLVDWGDASRHYHEALWFYLKVGLVGLLVIYHFVCGYYRKKLIGNAHYKSHKFWRFFNEMPTLILFAVVILVVVKPQF

SEQ ID NO: 97 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVILVVVKPQF

SEQ ID NO: 98 - protein, 150 aa, Acinetobacter
MDAPSDAFLWVKALHIIAVVCWFAALFYLPRLFVYHAMSEDALSHQRFEVMERKLYRGIMWPSMIATLITAHFLVDWGDATRHYHDALWFYLKVGLVGLLVIYHFVCGYYRKKLIGNAHYKSHKFWRFFNEMPTLILFAVVILVVVKPQF

SEQ ID NO: 99 - protein, 150 aa, Acinetobacter
MDAPSDAFLWVKALHIIAVVCWFAALFYLPRLYVYHAMSEDAISHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVILVVVKPQF

SEQ ID NO: 100 - protein, 150 aa, Acinetobacter
MDAPSDAFLWVKALHIIAVVCWFAALFYLPRLYVYHAMSEDKVSHQRFEVMERKLYRGIMWPSMLATLITAHFLVDWGDATRHYHEALWFYLKVGLVGLLVIYHFVCGYYRKKLISNAHYKSHQFWRFFNEMPTLILFAVVILVVVKPQF

SEQ ID NO: 101 - protein, 150 aa, Acinetobacter
MDAPSDAFLWVKALHIIAVVCWFAALFYLPRLYVYHAMSEDEISHQRFEVMERKLYRGIMWPSMIATLVTAHFLVEWGDATRHYHEAIWFYLKVGLVGLLVIYHFVCGYYRKKLIGNAHYKSHKFWRFFNEMPTLLLFAIIILVVVKPQF

SEQ ID NO: 102 - protein, 150 aa, Acinetobacter
MDAPSDAFLWVKALHIIAVVCWFAALFYLPRLYVYHAMSEDAISHQRFEVMERKLYRGIMWPSMIATLVTAHFLVEWGDATRHYHEALWFYLKVGLVGLLVIYHFVCGYYRKKLIGNAHYKSHKFWRFFNEMPTLLLFAIIILVVVKPQF

SEQ ID NO: 103 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 104 - protein, 150 aa, Acinetobacter
MDAPSDAFLWVKALHIIAVVCWFAALFYLPRLYVYHAMSEDAISHQRFEVMERKLYRGIMWPSMIATLLTAHFLVDWGDATRHYHEALWFYMKVGLVGLLVIYHFVCGYYRKKLIGNAHYKSHRFWRFFNEMPTLLLFAIIILVVVKPQF

SEQ ID NO: 105 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHDALWFYLKVGLVGLLVIYHFVCGYYRKKLIGHAHYKSHKFWRFFNEMPTLILFAVVILVVVKPQF

SEQ ID NO: 106 - protein, 150 aa, Acinetobacter
MDAPSEAFLWVKALHIIAVVCWFAALFYLPRLYVYHAMSEDTVSHQRFEIMERKLYRGIMWPSMIATLITAHFLVDWGDATRHYHEALWFYLKVGLVGLLVIYHFVCGYYRKKLIGNAHYKSHKFWRFFNEMPTLILFAVIILVVVKPTF

SEQ ID NO: 107 - protein, 150 aa, Acinetobacter
MDAPSDAFLWVKALHIIAVVCWFAALFYLPRLYVYHAMSEDAISHQRFEVMERKLYRGIMWPSMIATLVTAHFLVEWGDATRHYHEAIWFYLKVGLVGLLVIYHFVCGYYRKKLIGNAHYKSHKFWRFFNEMPTLLLFAIIILVVVKPQF

SEQ ID NO: 108 - protein, 150 aa, Acinetobacter
MDAPSDAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 109 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHDALWFYLKVGLVGLLVIYHLVCGYYRKKLIGNAHYKSHRFWRFFNEMPTLILFAVVILVVVKPQF

SEQ ID NO: 110 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIGNAHYKSHKFWRYFNEMPTLILFAVVILVVVKPTF

SEQ ID NO: 111 - protein, 150 aa, Acinetobacter
MDAPSDAFLWVKALHIIAVVCWFAALFYLPRLFVYHAMSEDALSHQRFEVMERKLYRGIMWPSMIATLITAHFLVDWGDATRHYHDALWFYLKVGLVGLLVIYHLVCGYYRKKLIGNAHYKSHKFWRFFNEMPTLILFAVVILVVVKPQF

SEQ ID NO: 112 - protein, 150 aa, Acinetobacter
MDAPSDAFLWVKALHIIAVVCWFAALFYLPRLYVYHAMSEDAASHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 113 - protein, 150 aa, Acinetobacter
MDAPSDAFLWVKALHIIAVVCWFAALFYLPRLYVYHAMSEDEISHQRFEVMERKLYRGIMWPSMIATLVTAHLLVEWGDATRHYHEAIWFYLKVGLVGLLVIYHFVCGYYRKKLIGNAHYKSHKFWRFFNEMPTLLLFAIIILVVVKPQF

SEQ ID NO: 114 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKIGLVALLVVYHFVCGYYRKKLIGNAHYKSHKFWRFFNEMPTLILFAVVILVVVKPQF

SEQ ID NO: 115 - protein, 150 aa, Unknown
  Bacterial
MDAPSDAFLWVKALHIIAVVCWFAALFYLPRLYVYHAMSDDAVSHQRFEVMERKLYRGIMWPAMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 116 - protein, 150 aa, Acinetobacter
MDAPSDAFLWVKALHIIAVVCWFAALFYLPRLYVYHAMSEDAISHQRFEVMERKLYRGIMWPAMLATLITAHFLVDWGDATRHYHEALWFYLKVGLVGLLVIYHLVCGYYRKKLIGNAHYKSHKFWRYFNEMPTLILFAVVILVVVKPTF

SEQ ID NO: 117 - protein, 150 aa, Acinetobacter
MDAPSDAFLWVKALHIIAVVCWFAALFYLPRLYVYHAMSDDATSHQRFEIMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 118 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHEALWFYLKVALVGLLVIYHLVCGYYRKKLIGNAHYKSHKFWRFFNEMPTVILFAVVILVVVKPQF

SEQ ID NO: 119 - protein, 150 aa, Acinetobacter
MDAPSDAFLWVKALHIIAVVCWFAALFYLPRLYVYHAMSDDTVSHQRFEVMERKLYRGIMWPSMVATLITAHFLVDWGDATRHYHEALWFYIKVALVGLLVIYHFVCGYYRKKLIGNAHYKSHKFWRFFNEMPTLILFAVVILVVVKPHF

SEQ ID NO: 120 - protein, 150 aa, Acinetobacter
MDAPSDAFLWVKALHIIAVVCWFAALFYLPRLYVYHAMSEDAASHQRFEVMERKLYRGIMWPSMIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 121 - protein, 150 aa, Acinetobacter
MDAPSEAFLWVKALHIIAVVCWFAALFYLPRLFVYHAMSDDNLSHQRFEIMERKLYRGIMWPSMIATLITAHFLVDWGDATRHYHEALWFYLKVGLVGLLVIYHFVCGYYRKKLIGNAHYKSHKFWRFFNEMPTLILFAVVILVVVKPTF

SEQ ID NO: 122 - protein, 150 aa, Acinetobacter
MDAPSDAFLWVKALHIIAVVCWFAALFYLPRLYVYHAMSDDATSHHRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 123 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 124 - protein, 150 aa, Acinetobacter
MDAPSNAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 125 - protein, 150 aa, Acinetobacter
MDAPSDAFLWVKALHIIAVVCWFAALFYLPRLYVYHAMSEDVISHQRFEVMERKLYRGIMWPSMIATLLTAHFLVDWGDATRHYHEALWFYLKVSLVGLLVIYHFVCGYYRKKLIGNAHYKSHRFWRFFNEMPTLLLFAIIILVVVKPQF

SEQ ID NO: 126 - protein, 150 aa, Acinetobacter
MDAPSDAFLWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTFILFAVVILVVVKPQF

SEQ ID NO: 127 - protein, 150 aa, Acinetobacter
MDAPSDAFLWVKALHIIAVVCWLAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 128 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGHAHYKSHKFWRFFNEMPTLILFAVVILVVVKPTF

SEQ ID NO: 129 - protein, 150 aa, Acinetobacter
MDAPSDAFLWVKALHIIAVVCWFAALFYLPRLYVYNAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 130 - protein, 150 aa, Acinetobacter
MDAPSDAFLWVKALHIIAVVCWFAALFYLPRLYVYHAMSDDAASHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 131 - protein, 150 aa, Acinetobacter
MDAPSDAFLWVKALHIIAVVCWFAALFYLPRLYVYHAMSDDAASHQRFEVMERKLYRGIMWPSMIATLITAHFLVEWGDATRHYHEATWFYLKVGLVALLVVYHFVCGYYRKKLIGNAHYKSHKFWRFFNEMPTLILFAVVILVVVKPQF

SEQ ID NO: 132 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHEATWFYLKVGLVALLVVYHLVCGYYRKKLIGNAHYKSHKFWRFFNEMPTLILFAVVILVVVKPQF

SEQ ID NO: 133 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLINNAHYKSHKFWRYFNEMPTLILFAVVILVVVKPTF

SEQ ID NO: 134 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVALLVIYHLVCGYYRKKLIGNAHYKSHKFWRFFNEMPTLILFAVVILVVVKPQF

SEQ ID NO: 135 - protein, 150 aa, Acinetobacter
MDAPSDAFLWVKALHIIAVVCWFAALFYLQRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 136 - protein, 150 aa, Acinetobacter
MDAPSEAFLWVKALHIIAVVCWFAALFYLPRLFVYHAMSDDNLSHQRFEIMERKLYRGIMWPSMIATLITAHFLVDWGDATRHYHEALWFYLKVGLVGLLVIYHFACGYYRKKLIGNAHYKSHKFWRFFNEMPTLILFAVVILVVVKPTF

SEQ ID NO: 137 - protein, 150 aa, Acinetobacter
MDAPSDAFLWVKALHIIAVVCWFAALFYLPRLYVYHAMSEDTASHQRFEVMERKLYRGIMWPSMIATLITAHFLVDWGDATRHYHQATWFYLKVGLVALLVIYHLACGYYRKKLIGNAHYKSHKFWRFFNEMPTLILFAVIILVVVKPQF

SEQ ID NO: 138 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 139 - protein, 150 aa, Acinetobacter
MDAPSDAFLWVKALHIIAVVCWFAALFYLPRLYVYHAMSKDAASHQRFEVMERKLYRGIMWPSMIATLITAHFLVDWGDATRHYHQATWFYLKVGLVALLVIYHLVCGYYRKKLIGNAHYKSHKFWRFFNEMPTLILFAVVILVVVKPQF

SEQ ID NO: 140 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIDNAHYKSHKFWRYFNEMPTLILFAVVILVVVKPTF

SEQ ID NO: 141 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVTLLVIYHLVCGYYRKKLIGNAHYKSHKFWRFFNEMPTLILFAVVILVVVKPQF

SEQ ID NO: 142 - protein, 150 aa, Acinetobacter
MDAPTDAFLWVKALHIIAVVCWFAALFYLPRLYVYHAMSEDTISHQRFEVMERKLYRGIMWPSMIATLITAHFLVDWGDATQHYHQAVWFYLKVALVALLVIYHFVCGYYRKKLIGNAHYKSHKFWRFFNEMPTLILFAVVILVVVKPQF

SEQ ID NO: 143 - protein, 150 aa, Acinetobacter
MDAPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYNLVCGYYRKKLIGNAHYKSHKFWRFFNEMPTLILFAVVILVVVKPQF

SEQ ID NO: 144 - protein, 150 aa, Acinetobacter
MDAPSDAFLWVKALHIIAVVCWFAALFYLPRLYVYHAMSDDAVSHQRFEVMERKLYRGIMWPSMIATLITAHFLVEWGDATRHYHEALWFYLKVGLVGLLVIYHFVCGYYRKKLIGHAHYKSHKFWRFFNEMPTLILFAVVILVVVKPTF

SEQ ID NO: 145 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHDATWFYLKVGLVALLVIYHLVCGYYRKKLIGNAHYKSHKFWRFFNEMPTLILFAVVILVVVKPQF

SEQ ID NO: 146 - protein, 150 aa, Acinetobacter
MDAPSDAFLWVKALHIIAVVCWFAALFYLPRLYVYHAMSDDAASHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 147 - protein, 150 aa, Acinetobacter
MDVPSDAFLWVKALHIIAVVCWFAALFYLPRLYVYHAMSDDATSHQRFEVMERKLYRGIMWPSMIATLITAHFLVEWGDATRHYHEATWFYLKVGLVALLVIYHLVCGYYRKKLIGNAHYKSHKFWRFFNEMPTLILFAVVILVVVKPQF

SEQ ID NO: 148 - protein, 150 aa, Acinetobacter
MDAPSDAFLWVKALHIIAVVCWFAALFYLPRLYVYHAMSEDTVSHQRFEVMERKLYRGIMWPAMLATLITAHFLVDWGDATRHYHEALWFYLKVGLVGLLVIYHLVCGYYRKKLIDNAHYKSHKFWRYFNEMPTLLLFAVVILVVVKPTF

SEQ ID NO: 149 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVGLVALLMIYHLVCGYYRKKLIGNAHYKSHKFWRFFNEMPTLILFAVVILVVVKPQF

SEQ ID NO: 150 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGYYRKKLIDNAHYKSHKFWRYFNEMPTLLLFAVVILVVVKPTF

SEQ ID NO: 151 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVGLVALLVIYHLACGYYRKKLIGNAHYKSHKFWRFFNEMPTLILFAVVILVVVKPQF

SEQ ID NO: 152 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVGLVALLVIYHLVCGYYRKKLIGNAHYKSHRFWRFFNEMPTLILFAVVILVVVKPQF

SEQ ID NO: 153 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLICGYYRKKLINNAHYKSHKFWRYFNEMPTLILFAVVILVVVKPTL

SEQ ID NO: 154 - protein, 150 aa, Acinetobacter
MDAPSDAFLWVKALHIIAVVCWFAALFYLPRLYVYHAMSDDAISHQRFEVMERKLYRGIMWPAMIATLITAHFLVDWGDATRHYHEALWFYLKVGLVGLLVIYHLMCGYYRKKLIDNAHYKSHKFWRYFNEMPTLILFAVVILVVVKPTF

SEQ ID NO: 155 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVALVALLVIYHLVCGYYRKKLIGNAHYKSHKFWRFFNEMPTLILFAVVILVVVKPQF

SEQ ID NO: 156 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIRHAHYKSHKFWRFFNEMPTLILFAVVILVVVKPTF

SEQ ID NO: 157 - protein, 150 aa, Acinetobacter
MDAPSDAFLWVKALHIIAVVCWFAALFYLPRLYVYHAMSEDTVSHERFQVMERKLYRGIMWPAMVATLITAHFLVDWGDATRHYHEALWFYLKVGLVGLLVIYHLVCGYYRKKLIENAHYKSHKFWRFFNEMPTLILFAVVILVVVKPTF

SEQ ID NO: 158 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLVIYHLVCGYYRKKLIGNAHYKSHRFWRFFNEMPTLILFAVVILVVVKPQF

SEQ ID NO: 159 - protein, 150 aa, Acinetobacter
MDAPSDAFLWVKALHIIAVVCWFAALFYLPRLYVYHAMSEDAVSHQRFEVMERKLYRGIMWPSLIATLITAHFLVDWGDATRHYHQATWFYLKVALVALLVIYHLACGYYRKKLIGNAHYKSHKFWRFFNEMPTLILFAVVILVVVKPQF

SEQ ID NO: 160 - protein, 150 aa, Acinetobacter
MDAPSDAFLWVKALHIIAVVCWFAALFYLPRLYVYHAMSEDAVSHQRFEVMERKLYRGIMWPAMLATLITAHFLVDWGDATRHYHEALWFYLKVGLVGLLVIYHLVCGHYRKKLMENAHYKSHKFWRYFNEMPTLILFAVVILVVVKPTF

SEQ ID NO: 161 - protein, 150 aa, Acinetobacter
MDAPSDAFLWVKALHIIAVVCWFAALFYLPRLYVYHAMSEDVVSHQRFEIMERKLYRGIMWPAMVATLITAHFLVDWGDATRHYHEALWFYLKVGLVGLLVIYHLVCGYYRKKLMENAHYKSHKFWRFFNEMPTLILFAVVILVVVKPTF

SEQ ID NO: 162 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLIIYHLVCGYYRKKLIGNAHYKSHRFWRFFNEMPTLILFAVVILVVVKPQF

SEQ ID NO: 163 - protein, 150 aa, Acinetobacter
MDAPSDAFLWVKALHIIAVVCWFAALFYLPRLYVYHAMSEDAASHQRFEIMERKLYRGIMWPSMIATLITAHFLVEWGDATRHYHQATWFYLKVALVALLVIYHLVCGYYRKKLIGNAHYKSHRFWRFFNEMPTLILFAVVILVVVKPQF

SEQ ID NO: 164 - protein, 150 aa, Acinetobacter
MDAPTDAFLWVKALHIIAVVCWFAALFYLPRLYVYHAMSEDTISHQRFEVMERKLYRGIMWPSMIATLITAHFLVDWGDGTQHYHQAGWFYLKVALVALLVIYHFVCGYYRKKLIGNAHYKSHKFWRFFNEMPTLILFAVVILVVVKPQF

SEQ ID NO: 165 - protein, 150 aa, Acinetobacter
MDAPSDAFLWVKALHIIAVVCWFAALFYLPRLYVYHAMSEDAASHQRFEIMERKLYRGIMWPSLIATLITAHFLVDWGDATRHYHQATWFYLKVALVALLVIYHLACGYYRKKLIGNAHYKSHKFWRFFNEMPTLILFAVVILVVVKPQF

SEQ ID NO: 166 - protein, 150 aa, Acinetobacter
MDAPSDAFLWVKALHIIAVVCWFAALFYLPRLYVYHAMSEDVVSHQRFEIMERKLYRGIMWPAMVATLITAHFLVDWGDATRHYHEALWFYLKVGLVGLLVIYHLICGYYRKKLMENAHYKSHKFWRFFNEMPTLILFAVVILVVVKPTF

SEQ ID NO: 167 - protein, 150 aa, Acinetobacter
MDAPSDAFLWVKALHIIAVVCWFAALFYLPRLYVYHAMSEDAASHQRFEVMERKLYRGIMWPSMIATLITAHFLVEWGDATRHYHQATWFYLKVALVALLVIYHLVCGYYRKKLIGNAHYKSHRFWRFFNEMPTVILFAVVILVVVKPQF

SEQ ID NO: 168 - protein, 150 aa, Acinetobacter
MDAPSDAFLWVKALHIIAVVCWFAALFYLPRLYVYHAMSEDTLSHQRFEIMERKLYRGIMWPSMIATLITAHFLVDWGDATRNYHDALWFYLKVALVGLLVIYHLVCGYYRQKLIGNAHYKSHKFWRFFNEMPTVLLLAIVILVVVKPQF

SEQ ID NO: 169 - protein, 150 aa, Acinetobacter
MDAPSDAFLWVKALHIIAVVCWFAALFYLPRLYVYHAMSEDAVSHARFQVMERKLYRGIMWPAMLATLITAHFLVDWGDATRHYHEAVWFYLKVGLVGLLVIYHLVCGHYRKKLMENAHYKSHKFWRYFNEMPTLILFAVVILVVVKPTF

SEQ ID NO: 170 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRNYHDALWFYLKVALVGLLVIYHLVCGYYRLKLIGNAHYKSHKFWRFFNEMPTVLLFAIVILVVVKPVF

SEQ ID NO: 171 - protein, 150 aa, Acinetobacter
MDAPSDAFLWVKALHIIAVVCWFAALFYLPRLYVYHAMSEDAVSHQRFEVMERKLYRGIMWPSMIATLITAHFLVDWGDATRHYHEALWFYLKVGLVGLLVIYHLVCGYYRKKLIGNAHYKTHKFWRFFNEMPTLILFAVVVLVVVKPQF

SEQ ID NO: 172 - protein, 150 aa, Acinetobacter
MDAPSSAFLWVKALHIIAVVCWFAALFYLPRLYVYHAMSKDQASYERFQIMERKLYRGIMWPAMIATLITAHFLVDWGDATRHYHEALWFYFKVGLVGLLIIYHFVCGYYRKKLIDNAHYKTHKFWRMFNELPTVILFAVVILVVVKPQF

SEQ ID NO: 173 - protein, 149 aa, Acinetobacter
MNAPSDAFFWIKALHIIAVVCWFAALFYLPRLYVYHAMSDDTVSHQRFEVMERKLYRGIMWPAMIATLITAHFLVDWGDQFYHYHEALWFYLKVALVGLLVIYHFVCGYYRKKLIGNAHYKTHKFWRFFNEMPTLLLFAIVILVVVKPF

SEQ ID NO: 174 - protein, 150 aa, Acinetobacter
MDAPSDAFLWVKALHIIAVVCWFAALFYLPRLYVYHAMSEDTVSHQRFEVMERKLYRGIMWPSMIATLITAHFLVDWGDATRHYHEALWFYLKVGLVGLLVIYHFVCGYYRKKLIGNAHYKSHKFWRFFNEMPTLILLAVVILVVVKPQF

SEQ ID NO: 175 - protein, 142 aa, Acinetobacter
MWVKALHIIAVVCWFAALFYLPRLYVYHAMSDDATSHQRFEVMERKLYRGIMWPSMIATLITAHFLVDWGDATRHYHEATWFYLKVGLVALLVIYHLVCGYYRKKLIGNAHYKSHKFWRFFNEMPTLILFAVVILVVVKPQF

SEQ ID NO: 176 - protein, 150 aa, Acinetobacter
MDAPSDAFLWVKALHIIAVVCWFAALFYLPRLYVYHAMSDDAVSHQRFEVMERKLYRGIMWPSMIATLITAHFLVDWGDATRHYHEALWFYLKVGLVGLLVIYHFVCGYYRKKLIGNAHYKSHKFWRFFNEMPTLILVAVIILVVVKPQF

SEQ ID NO: 177 - protein, 150 aa, Acinetobacter
MDAPSDAFLWVKALHIIAVVCWFAALFYLPRLYVYHAMSEDAVSHQRFEVMERKLYRGIMWPSMIATLVTAHFLVDWGDATRHYHEALWFYLKVALVGLLVIYHLVCGYYRKKLIGNAHYKSHKFWRFFNEMPTVILLAVVILVVVKPQF

SEQ ID NO: 178 - protein, 150 aa, Acinetobacter
MDAPSDAFLWVKALHIIAVVCWFAALFYLPRLYVYHAMSEDGTSHQRFQIMERKLYRGIMWPSMLATLITAHFLVDWGDATRHYHEALWFYLKVGLVGLLVIYHFVCGYYRKKLMENPHYKSHKFWRFFNEMPTLILLAVVILVVVKPQF

SEQ ID NO: 179 - protein, 150 aa, Acinetobacter
MNAPSEAFLWVKALHIIAVVCWFAALFYLPRLYVYHAMSDDDASHQRFEVMERKLYRGIMWPAMIATLITAHFLVDWGDATYHYHEALWFYLKVGLVGLLVIYHFVCGYYRKKLIGNAHYKSHKFWRVFNEMPTLILLAVVILVVVKPTF

SEQ ID NO: 180 - protein, 148 aa, Acinetobacter
MVSEAFLWVKALHIIAVVCWFAALFYLPRLYVYHAMSDDLASHQRFEVMERKLYRGIMWPAMIATLITAHFLVDWGDATQHYHEATWFYIKVALVGLLVIYHFVCGYYRKKLIGNAHYKSHKFWRFFNEMPTLLLLAIVILVVVKPQF

SEQ ID NO: 181 - protein, 150 aa, Acinetobacter
MNAPSDAFLWVKALHIIAVVCWFAALFYLPRLYVYHAMSDDAISHQRFQVMERKLYRGIMWPAMIATLITAHFLVAWGDATQHYHLAHWFYVKVALVGLLVIYHFVCGYYRKKLIENAHYKSHKFWRFFNEMPTVILLAVVILVVVKPQF

SEQ ID NO: 182 - protein, 150 aa, Acinetobacter
MNAPSDAFLWVKALHIIAVVCWFAALFYLPRLYVYHAMSDDAISHQRFQVMERKLYRGIMWPAMIATLITAHFLVAWGDATQHYHLAHWFYLKVALVGLLVIYHFVCGYYRKKLIENAHYKSHKFWRFFNEMPTVILLAVVILVVVKPQF

SEQ ID NO: 183 - protein, 150 aa, Acinetobacter
MDVPSDAFLWVKAFHIISIVCWFAALFYLPRLYVYHAMSNDAVSHQRFQVMERKLYRGIMWPSMIATLITAHFLVDWGDATQHYHEALWFYLKLGLVGLLVIYHLFCGYYRQKLILDAHYKSHKFWRFFNEMPTFILVAVIILVVVKPHF

SEQ ID NO: 184 - protein, 181 aa, Escherichia
MKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 185 - protein, 181 aa, Escherichia; identical to SEQ ID NO: 184

SEQ ID NO: 186 - protein, 181 aa, Enterobacter
MKTLILFSTRDGQTREIASYLASELKELGIQADVTNVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 187 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVYTDWEQVANFAREIAHLTDKPTLK

SEQ ID NO: 188 - protein, 181 aa, Escherichia
MKTLILFSTRDGQTREIAAYLASELKELGIQADVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 189 - protein, 180 aa, Shigella
MKTLILFSTRDGQTREISSYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVTDWEQVANFAREIAHLTDKPTLK

SEQ ID NO: 190 - protein, 181 aa, Escherichia
MKTLILFSTRDGQTREIASYLASELKELGIQADVANVHRTEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 191 - protein, 181 aa, Escherichia
MKTLILFSTRDGQTREIASYLASELKELGIQADVANVHRIEEPQWENYDRVVIGASIRYGHYHSAFQEFVKKHATQLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTPK

SEQ ID NO: 192 - protein, 181 aa, Shigella
MKTLILFSTRDGQTREIASYLASELKELGIQTDVANVHRIEEPQWENYGRVVIGASIRYGHYHSAFQEFVKKHATRLNSMPSAFYSVNLVARKPEKRTPQTNSYARKFLMNSQWRPDRCAVIAGALRYPRYRWYDRFMLKLIMKMSGGETDTRKEVVYTDWEQVANFAREIAHLTDKPTLK

SEQ ID NO: 193 - protein, 181 aa, Escherichia
MKTLILFSTRDGQTREIASYLASELKELGIQADVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWQQVENFAREIAHLTDKPTLK

SEQ ID NO: 194 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAQLTNKPTLK

SEQ ID NO: 195 - protein, 181 aa, Escherichia
MKTLILFSTRDGQTREIASYLASELKELGIQADVANVHRTEEPQWENYDRVVIGASIRYGHYHSAFEEFVKKHETRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTLK

SEQ ID NO: 196 - protein, 181 aa, Escherichia
MKTLILFSTRDGQTREIASYLASELKELGILADVANVHRTEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAHLTDKPTMK

SEQ ID NO: 197 - protein, 181 aa, Enterobacter
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAQLTNKPTLK

SEQ ID NO: 198 - protein, 181 aa, Shigella
MKTLILFSTRDGQTREIASYLASELKELGIQTDVANVHRIEEPQWKNYDRVVIGASIRYGHYHSAFQEFVKKHATRLNSMPSAFYSVNLVARKPEKRTPQTNSYARKFLMSSQWRPDRCAVIAGALRYPRYRWYDRFMIKLIMKMSGGETDTRKEVVYTDWEQVANFAREIAQLTNKPTLK

SEQ ID NO: 199 - protein, 181 aa, Shigella
MKTLILFSTRDGQTREIASYLASELKELGIQTDVANVHRIEEPQWENYDRVVIGASIRYGHYHSAFQEFVKKHATRLNSMPSAFYSVNLVARKPEKRTPQTNSYARKFLMSSQWRPDRCAVIAGALRYPRYCWYDRFMIKLIMKMSGGETDTRKEVVYTDWEQVANFAREIAQLTNKPTLK

SEQ ID NO: 200 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTRKEVVYTDWEQVANFAREIAHLTNKSSAK

SEQ ID NO: 201 - protein, 161 aa, Shigella
MASELKELGIQADVANVHRIEEPQWENYDRVVIGASIRYGHYHSAFQEFVKKHATRLNSMPSAFYSVNLVARKPEKRTPQTNSYARKFLMNSQWRPDRCAVIAGALRYPRYRWYDRFMIKLIMKMSGGETDTRKEVVYTDWEQVANFAREIAHLTDKPTLK

SEQ ID NO: 202 - protein, 181 aa, Citrobacter
MKTLILFSTRDGQTREIASYLASELKELGIWADVVNLHRTEEPEWDSYDRVVIGASIRYGHYHTAFQEFVKKHATRLNGMPSAFYSVNLVARKPEKRTPQTNSYARKFLMSSQWRPDRCAVIAGALLYPRYRWYDRIMIKLIMKMSGGETDTNKEVIYTDWEQVAGFAREIAQLTVKSPVK

SEQ ID NO: 203 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKMSGGETDTSKEVVYTDWEQVANFAREIAHLTNKSSAK

SEQ ID NO: 204 - protein, 181 aa, Citrobacter
MKTLILFSTRDGQTREIASYLASELKELGIWADVINLHRTEELDWQSYDRVVIGASIRYGHYHAAFQEFVKKHATRLNAMPSAFYSVNLVARKPEKRTPQTNSYARKFLMSSQWRPDLCAVIAGALRYPRYRWYDRLMIKLIMKMSGGETDTSKEVVYTDWEQVANFARDIAQLTNKSLAK

SEQ ID NO: 205 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKMSGGETDTSKEVVYTDWDQVANFAREIAHLTNKSSAK

SEQ ID NO: 206 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDHCAVIAGALRYPRYRWYDRLMIKLIMKLSGGETDTSKEVVYTDWEQVANFAREIAHLTNKSSAK

SEQ ID NO: 207 - protein, 181 aa, Salmonella
MKTLILFSTRDGQTREIASYLASELKEMGIWADVVNLHRAEEPDWDKYDRVVIGASIRYGHYHSAFQEFVKKYSTRLNGMPSAFYSVNLVARKPEKRTPQTNSYARKFLMNSPWRPDHCAVIAGALRYPCYRWYDRLMIKLIMKMSGGETDTSKEVVYTDWDQVAKFAREIAHLTNKPSSK

SEQ ID NO: 208 - protein, 181 aa, Citrobacter
MKTLILFSTRDGQTREIASYLASELKELGIWADVINLHRTEELDWQSYDRVVIGASIRYGHYHAAFQEFVKKHATRLNAMPSAFYSVNLVARKPEKRTPQTNSYARKFLMSAQWRPDLCAVIAGALRYPRYRWYDRLMIKLIMKMSGGETDTSKEVVYTDWEQVANFARDIAQLTNKSLAK

SEQ ID NO: 209 - protein, 181 aa, Salmonella
MKTLILFSTRDGQTREIASYLASELKEMGIRADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 210 - protein, 181 aa, Citrobacter
MKTLILFSSRDGQTREIAAYLASELKELGIWADVFNLHRTEEPDWESYDRVVIGASIRYGHYHSAFLDFVKKHATRLNQMPSAFYSVNLVARKPEKRTPQTNSYARKFLMHSQWRPDRSAVIAGALLYPRYRWYDRIMIKLIMKMSGGETDTRKEVIYTDWEQVASFAREIAQLTDKSSVK

SEQ ID NO: 211 - protein, 181 aa, Salmonella
MKTLILFSTRDGQTREIASYLASELKEMGIWADVVNLHRAEEPDWDKYDRVVIGASIRYGHYHSAFQEFVKKYATRLNGMPSAFYSVNLVARKPEKRTPQTNSYARKFLMSSPWRPDHCAVIAGALRYPCYRWYDRLMIKLIMKMSGGETDTSKEVVYTDWDQVAKFAREIAHLTNKPSSK

SEQ ID NO: 212 - protein, 181 aa, Citrobacter
MKTLILFSTRDGQTREIASYLASELKALGIWADVINLHRTEELDWQSYDRVVIGASIRYGHYHAAFQEFVKKHATRLNAMPSAFYSVNLVARKPEKRTPQTNSYARKFLMSSQWRPDLCAVIAGALRYPRYRWYDRLMIKLIMKMSGGETDTSKEVVYTDWEQVANFARDIAQLTNKSLAK

SEQ ID NO: 213 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 214 - protein, 181 aa, Salmonella
MKTLILFSTRDGQTREIASYLASELKEMGIWADVVNLHRAEEPDWDCYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 215 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVSRKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 216 - protein, 181 aa, Salmonellaenterica
MKTLILFSTRDGQTREIASYLASELKDMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 217 - protein, 181 aa, Salmonella
MKTLILFSTRDGQTREIASYLASELKEMGIWGDVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 218 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKFIMKMSGGETDTSKEVVYTDWEQVAHFAREIAHLTNKSSAK

SEQ ID NO: 219 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEAVYTDWEQVAHFAREIAHLTNKSSAK

SEQ ID NO: 220 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 221 - protein, 181 aa, Salmonella
MKTLILFSTRDGQTHEIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 222 - protein, 181 aa, Salmonella
MKTLILFSTRDGQTREIASYLASELKEMGIWADVVNLHRAEEPDWDSYDRVVIGASIRYGHYHSAFQEFVKKYAKRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 223 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMQMSGGETDTSKEVVYTDWEQVTHFAREIAHLTNKSSAK

SEQ ID NO: 224 - protein, 181 aa, Salmonella
MKTLILFSTWDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 225 - protein, 181 aa, Salmonella
MKTLILFSTRDGQTREIASYLASELKEMGIWADVVNLHRAEEPDWDKYDRVVIGASIRYGHYHSAFQEFVKKYATRLNGMPSAFYSVNLVARKPEKRTPQTNSYARKFLMSSPWRPDYCAVIAGALRYPCYRWYDRLMIKLIMKMSGGETDTSKEVVYTDWDQVAKFAREIAHLTNKLSSK

SEQ ID NO: 226 - protein, 181 aa, Salmonella
MKTLILFSTRDGQTREIASYLASELKEMGIWGDVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPSYRWYDRLMIKLIMKMSGGETDTSKEVVYTDWEQVAHFAREIAHLTNKSSAK

SEQ ID NO: 227 - protein, 181 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLNNKSSAK

SEQ ID NO: 228 - protein, 181 aa, Salmonella
MKILILFSTRDGQTREIASYLASELKEMGIWADVVNLHRAEEPDWDSYDRVVIGASIRYGHYHSAFQEFVKKYAPRLNGMPSAFYSVNLVARKAEKRTPQTNSYARKFLMSSPWRPDHCAVIAGALRYPRYRWYDRLMIKLIMKMSGGETDTSKEVVYTDWDQVANFAREIAHLTNKSSAK

SEQ ID NO: 229 - protein, 181 aa, Citrobacter
MKTLILFSSRDGQTREIAAYLASELKELGICTDVVNLHRIEEPDWERYDRVVIGASIRYGHYHSAFLEFVKKHATRLNHMPSAFYSVNLVARKPEKRTPQTNSYARKFLMNSQWRPDRSAVIAGALLYPRYRWYDRMMIQLIMKMSGGETDTRKEVIYTDWEQVASFAREVAQLTPDSLVK

SEQ ID NO: 230 - protein, 176 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTN

SEQ ID NO: 231 - protein, 181 aa, Salmonella
MKTLILFSTRDGQTREIASYLASELKEMGIWADVVNLHRAEEPDWDSYDRVVIGASIRYGHYHSAFQEFVKKYATRLNGMSSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 232 - protein, 181 aa, Salmonella
MKTLILFSTRDGQTREIASYLASELKEMGIWADVVNLHRAEELDWDSYDRVVIGASIRYGHYHSSFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 233 - protein, 181 aa, Citrobacter
MKTLILFSSRDGQTREIAEYLASELKELGVWADVVNLHRTEEPDWKNYDSVVIGASIRYGHYHTAFQEFVKKHATRLNAMPSAFYSVNLVARKPEKRTPQTNSYARKFLMSSPWRPDRSAVIAGALLYPRYRWYDRVMIKLIMKMSGGETDTSKEVVYTDWEQVAIFAREIAQLTNKALLK

SEQ ID NO: 234 - protein, 181 aa, Citrobacter
MKTLILFSSRDGQTREIAAYLASELKELGVCTDVVNLHRTEEPDWERYDRVVIGASIRYGHYHSAFLEFVKKHATRLNHMPSAFYSVNLVARKPEKRTPQTNSYARKFLMNSQWRPDRSAVIAGALLYPRYRWYDRMMIQLIMKMSGGETDTRKEVIYTDWEQVASFAREIAQLTPDSVVK

SEQ ID NO: 235 - protein, 181 aa, Shigella
MKTLILFSSRDGQTREIAEYLASELKELGVWADVMNLHRTEEPEWKNYDSVVIGASIRYGHYHSAFQEFVKKHATQLNTMPSAFYSVNLVARKPEKRTPQTNSYARKFLMSSPWRPDHSAVIAGALLYPRYRWYDRVMIQLIMKMSGGETDTKKEVIYTDWEQVAGFAREIAQLTNKTLLK

SEQ ID NO: 236 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKASLK

SEQ ID NO: 237 - protein, 181 aa, Enterobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKTSLK

SEQ ID NO: 238 - protein, 174 aa, Salmonella
MKTLILFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHL

SEQ ID NO: 239 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMGSPWRPDHSAVIAGALLYPRYRWYDRVMIQLIMKMSGGETDTNKEVVYTDWEQVARFAREIAQLTNKTSLK

SEQ ID NO: 240 - protein, 181 aa, Citrobacter
MKTLILFSSRDGQTREIAEYLASELKELGVWADVLNLHRTAEPDWQNYDSVVIGASIRYGHYHAAFQEFVKKHATRLNAMPSAFYSVNLVARKPEKRTPQTNSYARKFLMSSPWRPDRSAVIAGALRYPRYRWYDRVMIQLIMKMSGGETDTHKEVVYTDWEQVAGFAREIAQLTHKTVSK

SEQ ID NO: 241 - protein, 181 aa, Citrobacter
MKTLILFSSRDGQTREIAEYLASELKELGVWADVVNLHRTAEPDWQNYDSVVIGASIRYGHYHAAFQEFVKKHATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKALLK

SEQ ID NO: 242 - protein, 181 aa, Citrobacter
MKTLILFSSRDGQTREIAEYLASELKELGVWADVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTNKTLSK

SEQ ID NO: 243 - protein, 181 aa, Citrobacter
MKTLILFSSRDGQTREIAEYLASELKELGVWADVVNLHRTAEPDWQNYDSVVVGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTNKTLSK

SEQ ID NO: 244 - protein, 181 aa, Citrobacter
MKTLILFSSRDGQTREIAEYLASELKELGVWADVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVADFAREIAQLTHKTLSK

SEQ ID NO: 245 - protein, 181 aa, Citrobacter
MKTLILFSSRDGQTQEIAAYLASELKELGISTDVVNLHRTDEPDWERYDRVVIGASIRYGHYHSAFLAFVKKHATRLNRMPSAFYSVNLVARKPEKRTPQTNSYARKFLMNSQWRPDRSAVIAGALLYPRYRWYDRMMIQLIMKMSGGETDTRKEVIYTDWAQVASFAREIAQLTPDSLVK

SEQ ID NO: 246 - protein, 181 aa, Citrobacter
MKTLILFSSRDGQTREIAEYLASELKELGVWADVVNLHRTAEPDWQNYDSVVIGASIRYGHYHAAFQEFVKKYATRLNSMPSAFYSVNLVARKPEKRTPQTNSYARKFLMSSPWRPDHSAVIAGALLYPRYRWYDRVMIQLIMKMSGGETDTNKEVVYTDWEQVARFAREIAQLTNKALLK

SEQ ID NO: 247 - protein, 181 aa, Citrobacter
MKTLILFSSRDGQTREIAEYLASELKELGVWADVVNLHRTAEPDWQHYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTNKEVVYTDWEQVADFAREIAQLTHKTLSK

SEQ ID NO: 248 - protein, 181 aa, Citrobacter
MKTLILFSSRDGQTREIAEYLASELKELGVWTDVVNLHRTAEPDWQNYDSVVIGASIRYGHYHAAFQEFVKKHATRLNAMPSAFYSVNLVARKPEKRTPQTNSYARKFLMSSPWRPDRSAVIAGALLYPRYRWYDRVMIQLIMKMSGGETDTHKEVVYTDWEQVAGFAREIAQLTHKTLPK

SEQ ID NO: 249 - protein, 187 aa, Salmonella
MNNGVTRENIDSFSTRDGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVTHFAREIAHLTNKSSAK

SEQ ID NO: 250 - protein, 181 aa, Citrobacter
MKTLILFSSRDGQTREIAEYLASELKELGVWTDVVNLHRTAEPDWKNYDSVVIGASIRYGHYHSAFQEFVKKYATRLNAMPSAFYSVNLVARKPEKRTPQTNSYARKFLMSSPWRPDRSAVIAGALLYPRYRWYDRVMIQLIMKMSGGETDTNKEVVYTDWEQVAGFAREIAQLTHKTLPK

SEQ ID NO: 251 - protein, 171 aa, Salmonella
DGQTREIASYLASELKEMGIWADVVNLHRAEEPDWDSYDRVVIGASIRYGHYHSAFQEFVKKYATRLNGMPSAFYSVNLVARKAEKRTPQTNSYARKFLMSSPWRPDYCAVIAGALRYPRYRWYDRLMIKLIMKMSGGETDTSKEVVYTDWEQVAHFAREIAHLTNKSSAK

SEQ ID NO: 252 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLTDNSRLK

SEQ ID NO: 253 - protein, 181 aa, Enterobacter
MKTLILFSTRDGQTREIAAYLASELKELGIYSDVVNLNRVEQISWQDYDRVVIGASIRYGHFHPALDRFVKKHTAVLNKLPGAFYSVNLVARKPEKRTPQTNSYTRKFLLSSPWQPELCAVFAGALRYPRYRWYDRFMIRLIMKMTGGETDTRKEVVYTDWSQVASFAREIAHLTDDSRHK

SEQ ID NO: 254 - protein, 181 aa, Enterobacter
MKTLILFSTRDGQTREIAAYLASELKELGIYSDVVNLNRAEQISWQDYDRVVIGASIRYGHFHPALDRFVKKHTAVLNKLPGAFYSVNLVARKPEKRTPQTNSYTRKFLLNSPWQPDLCAVFAGALRYPRYRWYDRFMIRLIMKMTGGETDTRKEVVYTDWSQVASFAREIAHLTGDSRHK

SEQ ID NO: 255 - protein, 181 aa, Enterobacter
MKTLILFSTRDGQTREIAAYLASELKELGIYSDVVNLNRAEQIAWQDYDRVVIGASIRYGHFHPALDRFVKKHAAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 256 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLTGNSRLK

SEQ ID NO: 257 - protein, 181 aa, Enterobacter
MKTLILFSTRDGQTREIAAYLASELKELGIYSDVVNLNRADQITWQDYDRVVIGASIRYGHFHPALDRFVKKHTAKLNTLPGAFYSVNLVARKPEKRTPQTNSYTRKFLLNSPWQPELCAVFAGALRYPRYRWYDRFMIRLIMKMTGGETDTRKEVVYTDWSQVASFAREIAHLTGDSRHK

SEQ ID NO: 258 - protein, 181 aa, Enterobacter
MKTLILFSTRDGQTREIASYLASELKELGIYSDVVNLNRTEQITWQDYDRVVIGASIRYGHFHPALDRFVKKHTAVLNKLPGAFYSVNLVARKAEKRTPQTNSYTRKFLLNSPWRPDLCAVFAGALRYPRYRWYDRFMIRLIMKMTGGETDTRKEVVYTDWSQVASFAREIAHLSRDSQRK

SEQ ID NO: 259 - protein, 181 aa, Enterobacter
MKTLILFSTRDGQTREIAAYLASELKELGIYSDVVNLNRAEQITWQEYDRVVIGASIRYGHFHPALDRFVKKHTAVLNKLPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTDDSRLK

SEQ ID NO: 260 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 261 - protein, 181 aa, Enterobacter
MKTLILFSTRDGQTREIAAYLASELKELGIYSDVVNLNRAEQIAWQDYDRVVIGASIRYGHFHPALDRFVKKHTAILNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 262 - protein, 180 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVTDWSQVATFAREIAHLTGDSRLK

SEQ ID NO: 263 - protein, 181 aa, Enterobacter
MKTLILFSTRDGQTREIASYLASELKELGVYADVVNLNRTEEISWQDYDRVVIGASIRYGHFHPALDSFVKKHTAVLNALPGAFYSVNLVARKAEKRTPQTNSYTRKFLLGSPWQPDLCAVFAGALRYPRYRWYDRFMIRLIMKMTGGETDTRKEVVYTDWAQVASFAREIAQLTADSKVK

SEQ ID NO: 264 - protein, 181 aa, Enterobacter
MKTLILFSTRDGQTREIASYLASELQELGIYSDVVNLNRTEQIAWQDYDRVVIGASIRYGHFHPALDRFVKKHTAALNKLPGAFYSVNLVARKPEKRTPQTNSYTRKFLLNSPWQPDLCAVFAGALRYPRYRWYDRFMIRLIMKMTGGETDTRKEVVYTDWTQVSSFAREIAHLSPESRRI

SEQ ID NO: 265 - protein, 181 aa, Enterobacter
MKTLILFSTRDGQTREIAAYLASELKELGIYSDVVNLNRAEQIAWHDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 266 - protein, 181 aa, Enterobacter
MKTLILFSTRDGQTREIAAYLASELKELGIYSDVVNLNRAEQIAWQDYDRVVIGASIRYGHFHPALDRFVKKHTAKLNALPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRHK

SEQ ID NO: 267 - protein, 181 aa, Enterobacter
MKTLILFSTRDGQTREIASYLASELQELGIYSDVVNLNRTEQIAWQDYDRVVIGASIRYGHFHPALDRFVKKHTAALNKLPGAFYSVNLVARKPEKRTPQTNSYTRKFLLNSPWQPDLCAVFAGALRYPRYRWYDRFMIRLIMKMTGGETDTRKEVVYTDWTQVSSFARDIAHLSPESRRI

SEQ ID NO: 268 - protein, 181 aa, Enterobacter
MKTLILFSTRDGQTREIAAYLASELKELGIYSDVVNLNRAEQIAWQEYDRVVIGASIRYGHFHPALDRFVKKHTAVLNKLPGAFYSVNLVARKAEKRTPQTNSYTRKFLLSSPWQPDLCAVFAGALRYPRYRWYDRFMIRLIMKMTGGETDTRKEVVYTDWSQVASFAREIAHLTGDSRLK

SEQ ID NO: 269 - protein, 181 aa, Enterobacter
MKTLILFSTRDGQTREIAAYLASELKELGIYSDVVNLNRAEEIAWQEYDRVVIGASIRYGHFHPALDRFVKKHTAVLNTLPGAFYSVNLVARKAEKRTPQTNSYTRKFLLGSPWQPDLCAVFAGALRYPRYRWYDRFMIRLIMKMTGGETDTRKEVVYTDWSQVASFAREIAHLAGDSRLK

SEQ ID NO: 270 - protein, 181 aa, Enterobacter
MKTLILFSTRDGQTREIAAYLASELKELGIYSDVVNLNRAEQIAWQDYDRVVIGASIRYGHFHPALDRFVKKHTAVLNKMPGAFYSVNLVARKAEKRTPQTNSYTRKFLLSSPWQPDLCAVFAGALRYPRYRWYDRFMIRLIMKMTGGETDTHKEVVYTDWSQVASFAREIAHLTGDSRLK

SEQ ID NO: 271 - protein, 181 aa, Enterobacter
MKTLILFSTRDGQTREIASYLASELKELGIYSDVVNLNRTEQIAWQDYDRVVIGASIRYGHFHPALDRFVKKHTAVLNKLPGAFYSVNLVARKPEKRTPQTNSYTRKFLLSSPWQPDISAVFAGALRYPRYRWYDRFMIRLIMKMTGGETDTRKEVVYTDWSQVASFAREIAHLSGDSRLK

SEQ ID NO: 272 - protein, 181 aa, Enterobacter
MKTLILFSTRDGQTREIAAYLASELKELGIYSDVVNLNRAEQIAWQEYDRVVIGASIRYGHFHPALDRFVKKHTAVLNKLPGAFYSVNLVARKAEKRTPQTNSYTRKFLLGSPWQPDLCAVFAGALRYPRYRWYDRFMIRLIMKMTGGETDTRKEVVYTDWSQVASFAREIAHLTGDSRLK

SEQ ID NO: 273 - protein, 181 aa, Enterobacter
MKTLILFSTRDGQTREIAAYLASELKELGIYSDVVNLNRAEQITWQEYDRVVIGASIRYGHFHPALVRFVKKHTAVLNKLPGAFYSVNLVARKAEKRTPQTNSYTRKFLLSSPWQPALCAVFAGALRYPRYRWYDRFMIRLIMKMTGGETDTRKEVVYTDWSQVASFAREIAHLTDDSRLK

SEQ ID NO: 274 - protein, 181 aa, Enterobacter
MKTLILFSTRDGQTREIAAYLASELKELGIYSDVVNLNRVGQITWQDYDRVVIGASIRYGHFHPALDRFVKKHTAVLNKLPGAFYSVNLVARKAEKRTPQTNSYTRKFLLNSPWQPDLCAVFAGALRYPRYRWYDRFMIRLIMKMTGGETDTRKEVVYTDWSQVASFAREIAHLSGDSRVK

SEQ ID NO: 275 - protein, 299 aa, Escherichia [sequence omitted]

SEQ ID NO: 276 - protein, 299 aa, Escherichia
MKPDAHQVKQFLLNLQDTICQQLTAVDGAEFVEDSWQREAGGGGRSRVLRNGGVFEQAGVNFSHVHGEAMPASATAHRPELAGRSFEAMGASLVVHPHNPYVPTSHANVRFFIAEKPGADPVWWFGGGFDLTPFYGFEEDAIHWHRTARDLCLPFGEDVYPRYKKWCDEYFYLKHRNEQRGIGGLFFDDLNTPDFDRCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 277 - protein, 299 aa, Shigella
MKPDAHQVKQFLLNLQDTICQQLTAVDGAEFVEDSWQREAGGGGRSRVLRNGGIFEQAGVNFSHVHGEAMPASATAHRPELAGRSFEAMGVSLVVHPHNPYVPTSHANVRFFIAEKPGAEPVWWFGGGFDLTPFYGFEEDAIHWHRTARDLCLPFGEDVYPRYKKWCDDYFYLKHRNEQRGIGGLFFDDLNTPDFDHCFAFMQAVGKGYTDAYLPIVERRKAMAYGERERNFQLYRRGRYVEFNLVWDRGTLFGLQTGGRTESILMSMPPLVRWEYDYQPKDGSPEAALSEFIKVRDWV

SEQ ID NO: 278 - protein, 299 aa, Citrobacter
MKPDAQRVKQFLLSLQDDICQRLSAVDGAEFIEDSWQREAGGGGRSRVLRNGGIFEQAGVNFSHVHGDAMPASATAHRPELAGRSFEAMGVSLVVHPLNPYIPTSHANVRFFIAEKPGADPVWWFGGGFDLTPYYGIEEDAVHWHRTARDLCQPFGEDVYPRYKKWCDDYFFLKHRNEQRGIGGLFFDDLNTPDFDRCFAFMQAVGKGYTDAYLPIVGRRKTMSWGERERNFQLYRRGRYVEFNLVWDRGTLFGLQTGGRTESILMSMPPLVRWEYDYHPEDGSPEAALSDFIQVRDWV

SEQ ID NO: 279 - protein, 299 aa, Citrobacter
MKPDAQRVKQFLLTLQESICGQLCAVDGAQFVEDSWQREAGGGGRSRVLRNGGVFEQAGVNFSHVHGDAMPASATAHRPELAGRSFEAMGVSLVVHPLNPYIPTSHANVRFFIAEKPGADPVWWFGGGFDLTPYYGFAEDAVHWHRTARDLCLPFGEEVYPRYKKWCDDYFFLKHRNEQRGIGGLFFDDLNTPDFDHCFAFMQAVGKGYTEAYLPIVERRKAMIWGERERNFQLYRRGRYVEFNLVWDRGTLFGLQTGGRTESILMSMPPLVRWEYDWQPEDGSPEAALSEFIKARDWV

SEQ ID NO: 280 - protein, 308 aa, Salmonella
MKPDAHHVKQFLLRLQDDICQTLSAVDGVNFVEDSWRREAGGGGRSRVLRNGGIFEQAGVNFSHVHGDAMPASATAHRPELAGRSFEAMGVSLVVHPHNPYIPTSHANVRFFIAEKPGADPVWWFGGGFDLTPYYGFEEDAVHWHRTARDLCQPFGDDVYPRYKKWCDDYFYLKHRNEQRGVGGLFFDDLNTPDFDHCFAFMQAVGHGYTGAYLPIVERRKAMVWGERERNFQLYRRGRYVEFNLVWDRGTLFGLQTGGRTESILMSMPPLVRWEYGYQPEEGSPEAALCEFIQVRDWVSLPDNSSVS

SEQ ID NO: 281 - protein, 299 aa, Citrobacter
MKPDAQRVKQFLLSLQDNICQQLSAVDGAEFVEDNWQREAGGGGRSRVLRNGGIFEQAGVNFSHVHGEAMPASATAHRPELAGRSFEAMGVSLVVHPQNPYIPTSHANVRFFIAEKPGADPVWWFGGGFDLTPYYGFDEDAVHWHRTARDLCQPFGDDVYPRYKKWCDDYFFLKHRNEQRGIGGLFFDDLNTPDFDHCFAFMQAVGQGYTEAYLPIVERRKAMSWSERERDFQLYRRGRYVEFNLVWDRGTLFGLQTGGRTESILMSMPPLVRWEYDWQPEANSPEAALSEFIQVRDWV

SEQ ID NO: 282 - protein, 299 aa, Rhizobium [sequence omitted]

SEQ ID NO: 283 - protein, 299 aa, Vibrio
MKPDALRVKQFLLNLQDAICQQLTAIDGAEFVEDSWQRDAGGGGRSRVLRNGGIFEQAGVNFSHVHGDAMPASATAHRPELAGRSFEAMGVSLVVHPLNPYIPTSHANVRFFIAEKPDADPVWWFGGGFDLTPYYGFEEDAIHWHRTARDLCQPFGDDVYPRYKKWCDDYFFLKHRNEQRGIGGLFFDDLNTPDFDHCFAFMQAVGEGYTEAYLPIVERRKAMSWGERERNFQLYRRGRYVEFNLVWDRGTLFGLQTGGRTESILMSMPPLVRWEYDWQPDAGSPEAALSDFIQVREWV

SEQ ID NO: 284 - protein, 299 aa, Enterobacter
MKPDAQQVKTFLLALQDSICQQLAAVDGQTFSEDNWQRDGGGGGRSRVLRNGGVFEQAGVNFSHVHGDAMPASATAHRPELAGRSFEAMGVSLVVHPHNPYVPTSHANVRFFIAEKPGADPVWWFGGGFDLTPYYGFEEDAVHWHRTARDLCLPFGEDVYPRYKKWCDDYFYLRHRQEQRGIGGLFFDDLNTPDFDRCFAFMQAVGNGYTDAYLPIVERRKAMAFGERERDFQLYRRGRYVEFNLVWDRGTLFGLQTGGRTESILMSMPPLVRWEYDYQPEDGSPEAALSEFIRVRDWV

SEQ ID NO: 285 - protein, 299 aa, Enterobacter
MTVDANKVKTFLLQLQDDICQQLSALDGGAFIEDSWQRDAGGGGRSRVLRDGGIFEQAGVNFSHVHGDAMPASATAHRPELAGRSFEAMGVSLVVHPRNPYVPTSHANVRFFIAEKPGADPVWWFGGGFDLTPFYGFEEDAIHWHRTARDLCQPFGEDVYPRYKKWCDDYFFIKHRNEQRGIGGLFFDDLNTPDFDSCFAFMQAVGNGFTDAYLPIVKRRKAAIWGERERNFQLYRRGRYVEFNLVWDRGTLFGLQTGGRTESILMSMPPLVRWEYDYQPQAGSPEAALSEFIKVRDWV

SEQ ID NO: 286 - protein, 299 aa, Enterobacter
MKPDVQQVKAFLLQLQDAICAKLSAVDGKDFVEDSWQREGGGSGRSRVLRDGGIFEQAGVNFSHVHGDAMPASATAHRPELAGRSFEAMGVSLVVHPRNPYVPTSHANVRFFIAEKPGADPVWWFGGGFDLTPYYGFEEDAIHWHRTARDLCLPYGDEVYPRYKKWCDDYFFLKHRNEQRGIGGLFFDDLNTPDFDHCFAFMQAVGNGFTDAYLPIVERRKTTPYGERERDFQLYRRGRYVEFNLVWDRGTLFGLQTGGRTESILMSMPPLVRWEYDYHPQEGSPEAALSEFIKVKEWI

SEQ ID NO: 287 - protein, 300 aa, Kluyvera
MTINVQQVKAFLLKLQDDICQQLERVDGGTFIEDSWQREAGGGGRSRVLRDGSVFEQAGVNFSHVHGDAMPASATAHRPELAGRSFEAMGVSLVVHPRNPYVPTSHANVRFFIAEKPGAEPVWWFGGGFDLTPYYGFQEDAVHWHTVARDLCLPFGEDVYPRYKKWCDDYFHLKHRNEQRGIGGLFFDDLNTPDFDHCFGFMQAVGKGFTDAYLPIVERRKAMAYGERERDFQLYRRGRYVEFNLVWDRGTLFGLQTGGRTESILMSMPPLVRWEYNYQPEEGSPEAALSEFIKVKDWLL

SEQ ID NO: 288 - protein, 299 aa, Trabulsiella
MKPDAQQVKTVLLTLQDTLCQQLSATDGSGFTEDLWQRAAGGGGRSRVLRNGGVFEQAGVNFSHVHGDAMPASATAHRPELVGRSFEAMGVSLVIHPHNPYVPTSHANVRFFIAEKPGADPVWWFGGGFDLTPFYGFNEDAVHWHTTARDLCLPFGDEVYPRYKKWCDDYFWLKHRNEQRGIGGLFFDDLNTPDFDHCFAFMQAVGNGFTDAYLPIVERRKMMPFGEREREFQLYRRGRYVEFNLVWDRGTLFGLQTGGRTESILMSMPPLVRWEYNYEPEKGSPEAALSEFLQVRDWI

SEQ ID NO: 289 - protein, 299 aa, Raoultella
MKPDAHQVKRYLLQLQETICQKLSAIDGGEFVEDSWQREGGGGGRSRVLRDGGVFEQAGVNFSHVHGDAMPASATAHRPELAGRSFEAMGVSLVVHPWNPYVPTSHANVRFFIAEKPGAEPVWWFGGGFDLTPFYGFEEDAVHWHRTAHDLCQPFGEEVYPRYKKWCDDYFYLKHRHEQRGIGGLFFDDLNTPDFDHAFAFMQAVGNGYTDAYLPIVEQRKAMPYGERERNFQLYRRGRYVEFNLVWDRGTLFGLQTGGRTESILMSMPPLVRWEYDYQPEEGSPEAALSEFIQVREWI

SEQ ID NO: 290 - protein, 299 aa, Kosakonia
MTPEIAPVKNALLALQDKICRQLSDIDGATFVEDAWQRAEGGGGRSRVLRDGGVFEQAGVNFSHVHGDAMPASATAHRPELAGRSFEAMGVSLVVHPRNPYVPTSHANVRFFIAQKPGADPVWWFGGGFDLTPYYGFEEDAIHWHRTARDICLPFGEEIYPRYKKWCDDYFYLKHRNEQRGIGGLFFDDLNTPDFDHCFAFMQAVGNGYLDAYLPIVARRKALPYGERERDFQLYRRGRYVEFNLVWDRGTLFGLQTGGRTESILMSMPPLVRWEYNYQPAEGSPEAALSEFIQVKDWV

SEQ ID NO: 291 - protein, 299 aa, Enterococcus
MKPDAAQVKTFLLQLQDNLCQQLSAVDGAPFIEDAWQREGGGGGRSRVLREGRVFEQAGVNFSHVHGDAMPASATAHRPELAGRSFEAMGVSLVVHPLNPYVPTSHANVRFFIAEKPGADPVWWFGGGFDLTPYYGFEEDAVHWHRTARDLCLPFGEEVYPRYKKWCDDYFYLKHRQEQRGIGGLFFDDLNTPDFDHCFAFMQAVGNGYADAYLPIVERRKATPYGERERHFQLYRRGRYVEFNLVWDRGTLFGLQTGGRTESILMSMPPLVRWEYDYQPEPGSPEAALSEFIQVRDWL

SEQ ID NO: 292 - protein, 307 aa, Unknown
  gamma proteobacterium
MNQLPDINQVKAFLLSLQDQICQKLSAVDGRAQFKQDQWVREEGGGGQSRVLTGGAIFEQAGVNFSHVSGATLPASATAHRPELAGRSFQAMGVSLVIHPLSPYIPTSHANVRFFIAEKPGEAPVWWFGGGFDLTPYYGFEEDARHWHQTAADLCQPFGDDVYPKYKKWCDDYFFIKHRNEARGIGGLFFDDLNSPDFAHCFAFMQAVANGFTDAYLPIVERRKTLTWGEREREFQLYRRGRYVEFNLVWDRGTLFGLQTGGRTESILMSMPPLVRWEYGFEPDENSPEAALYRDFLPVRDWLAESE

SEQ ID NO: 293 - protein, 303 aa, Shewanella
MKPDATQVKAFLLDLQQRICEGLEQLDGEAKFVADSWEREEGGGGTSRVLTKGKVFEQAGVNFSHVTGAAMPASATAHRPELAGRSFEAMGVSLVIHPNNPYVPTTHANVRFFIAEKEGADPVWWFGGGFDLTPYYPFEEDVVAWHQSAKALCEPFGEDVYPKYKKWCDEYFFLPHRNETRGVGGLFFDDLNEPGFENSFAFMQAVGEGFLKAYAPIVEKRKETAYGERERDFQLYRRGRYVEFNLVYDRGTLFGLQTGGRTESILMSMPPLVRWQYAYTPEAGSPEAKLYSDFLKPREWLEA

SEQ ID NO: 294 - protein, 302 aa, Oceanimonas
MSSKPDTSAVKAFLLALQDNICRQLEQADGSGRFIEDSWTREEGGGGRSRVLRNGTVIEQGGVNFSHVYGAAMPASATAHRPELAGRSFEAMGVSLVIHPHNPHVPTSHANVRFFIAEKEGAEPVWWFGGGFDLTPFYPVEEDCRHWHQVSKDLCEPFGEDVYPKYKEWCDRYFYLKHRNETRGVGGLFFDDLNEWPFERCFAFMKAVGEGYLDAYLPIIARRKDTPYGEDERQFQLYRRGRYVEFNLVYDRGTLFGLQTGGRTESILMSMPPLARWEYDWQPEAGSREARLQAFLVPRSWV

SEQ ID NO: 295 - protein, 302 aa, Chromobacterium
MSHPHSDAVKAILLDLQDRICAALEGADGDGRFVEDAWQREAGGGGRSRVLSNGAVFEQAGVNFSHVHGDALPASATAHRPELAGRRFEAMGVSLVIHPHNPHVPTSHANVRFFIAEKAGEAPVWWFGGGFDLTPFYPVREDVVHWHTVARDLCAPFGPEVYPRYKKWCDEYFYLKHRNEARGVGGLFFDDLNEWGFDQSFAFMQAVGNGYLDAYLPIVQARKDTAWGARERQFQLYRRGRYVEFNLVWDRGTLFGLQSGGRTESILMSMPPLVRWEYGYQPEPGSAEALLYTDFLPPRDWV

SEQ ID NO: 296 - protein, 302 aa, Pseudogulbenkiania
MSHPHSDAVKSFLLDLQDRICAALEQADGKAQFAEDAWSREAGGGGRSRVLAGGGVFEQAGVNFSHVHGDALPASATAHRPELADRRFEAMGVSLVIHPSNPHVPTSHANVRFFIAEKDGEAPVWWFGGGFDLTPYYPQEEDAVHWHTVARDLCAPFGGEVYPRYKKWCDEYFHLKHRNEARGIGGLFFDDLNEWGFDKSFAFTRAVGDGYLDAYLPIVARRKEQAWGDRERQFQLYRRGRYVEFNLVWDRGTLFGLQSGGRTESILMSMPPLVRWEYGYQPEPGSPEARLYTDFLPPRDWV

SEQ ID NO: 297 - protein, 302 aa, Chromobacterium
MSHPHSNAVKSFLLDLQDRICAALEQADGKAQFAEDAWSREAGGGGRSRVLTGGEVFEQAGVNFSHVHGDALPPSASAHRPELAGRRFEAMGVSLVIHPSNPHVPTSHANVRFFIAEKDGEAPVWWFGGGFDLTPFYPQEEDAVHWHTVARDLCAPFGGDVYPRYKKWCDEYFHLKHRNEARGIGGLFFDDLNEWGFDKSFAFTRAVGDGYLDAYLPIVARRKEQAWGDRERQFQLYRRGRYVEFNLVWDRGTLFGLQSGGRTESILMSMPPLVRWEYGYQPEPGSPEARLYTDFLPPRDWV

SEQ ID NO: 298 - protein, 302 aa, Aeromonas
MSKPDVAQVKAFLLQLQDEICRGLELADGVGHFVEDAWLREGGGGGRTRVLRHGAVIEQGGVNFSHVHGDAMPASATAHRPELAGRRFEAMGVSLVIHPHNPYVPTSHANVRFFIAEKEGEEPIWWFGGGFDLTPFYPFEEDVRHWHQVSRDLCQPFGTDIYPEFKSWCDRYFFLKHRDETRGVGGLFFDDLNRWPFADCFAFMQVVGKGYLDAYLPIVERRKALAYGEREREFQLYRRGRYVEFNLVYDRGTLFGLQTGGRTESILMSMPPLARWEYDWQPPAGSPEALLYSDYLKPREWL

SEQ ID NO: 299 - protein, 310 aa, Glaciecola
MNTELPSHEKIAQVKAFLLKLQDNICQTLELSDGKARFVEDEWEREQGGGGRTRVLTNGAVIEQGGVNFSHVFGDQMPASATAARPELAGRRFQAMGVSLVIHPHNPYIPTSHANVRFFIAEKEGEAPIWWFGGGFDLTPFFPFKEDVVHWHKVAHDLCLPFGEDVYPKYKKWCDDYFYLKHRNETRGVGGLFFDDLNTPDFETAFGFMQAVGNGYLDAYVPIIEKRKNTEYGNMERDFQLYRRGRYVEFNLVYDRGTLFGLQTGGRTESILMSMPPLVRWEYNYVPDEHSAQGKLAAYLTPQDWLAGQS

SEQ ID NO: 300 - protein, 304 aa, Alteromonas
MDGKNAAEVIEQVKSYLLGLQDTICQTLELADGKGQFVEDSWQREEGGGGRSRVLKNGAVIEQGGVNFSHVFGSQMPASATANRPELAGRNFQAMGVSLVIHPHNPYIPTSHANVRFFIAEKEGEAPIWWFGGGFDLTPFYPFKDDVVHWHDTAKKLCKPFGEDVYPKYKKWCDEYFYLKHRNETRGVGGLFFDDLNEWGFEQSFAFMQAVGNGFIDAYVPIVERRKQTDYGERERDFQLYRRGRYVEFNLVFDRGTLFGLQTGGRTESILMSMPPLARWEYCYTPAPGSAEAKLTDWLKPTPW

SEQ ID NO: 301 - protein, 305 aa, Gilvimarinus
MTTTPDKHAVKAYLMDLQERICDSLAAVDGGRFAEDTWQRAEGGGGRSRVLADGAVIEKGGVNFSHVMGDAMPASATAHRPELAGRSFEAMGVSLVIHPANPYAPTSHANVRFFIAEKEGADPVWWFGGGYDLTPFYGFVEDCVHWHKTAFEACAPFGDDVYPRYKNWCDEYFYLKHRNEARGVGGLFFDDLNELGFDQSFAFMRAVGDSYLQAYRPILERRKDSPYGEREREFQLYRRGRYVEFNLVYDRGTLFGLQTGGRTESILMSLPPLVRWEYDFHPEPDSPEARLSRDFLPHQDWLARQ

SEQ ID NO: 302 - DNA, 453 bp, Acinetobacter
atggatgcaccttctgatgctttcttatgggtaaaagcattacatattattgccgtagtatgttggtttgctgccttattctatttacctcgactctatgtttaccatgccatgagtgaggatgacactagtcatcgtcgttttgaagtcatggagcgtaaactttatcgtgggattatgtggccttctatgattgcgacactgatcactgctcattttttggtagattggggcgatgcaacacgacattatcatgaagcactctggttttatatcaaagtcggattggtgggacttttagttatctatcattttgtttgcggctactaccgtaaaaaactgattggcaatgcccattataaatcacacaaattctggcgttattttaatgaaatgccgacactgattttatttgcagtcgtgatcctggtcgtggtcaaaccacaattttaa

SEQ ID NO: 303 - DNA, 1365 bp, Calditerrivibrio
ttatttgtttaagagatttttaaatctatccacattcataaagcttgttctggtgcaatcatttatacccacaccatataagatattaccaccgataaaaatgtcatcaaattttttatagaactcttcaaccttttcaactattttgtggtgcccgatgtagtactgggggattgctttttcccatctaaaatattttattttgtaaggctctctttttatttttaaagtttcttttatgtcatcgaaagccatcctgataagttcatcgtcggatttttcaattatccatctatttttatctccacccattatcgttctaacgattttgtatccatcccttgttctatcagggaatatcgaagaatcaaacagtgctcccaaaattcttttattctctgaatggggtatcagatagccgaagccatccagaggatcttccagatcctccggcttgaatataaacccagcaacaaaaacaggagggtaagtgatgttatttagatccctggatagatctttatcaagaactgagagcatttgggaaacagcataggccggggcatttatgaatattttatcgaactccatgatgcctttattggtatttaatatatatctgtttatttttttatctattgaaaatacttccgtattcaacatctttgtgatgcttgtggattcgagtaaatctgttatcatattatccagtccatttttgtatgaagtaaggattccgccggggcctgatgggccactttttttcccttttttctttatcatccctttaaaaaggccaccataatttatttccagatcccttattacggggaaacaggatcttaagctcatcttttcgggatcacctgcaaaaatgccagagaccattgggctgataaggtattcaagagcttctttccccaatcttcttctggcaaagtctgccacagattcatcttcaaggacacttttttgtatgaaatattcggatagtatcctcatttttgctgagaaggagagtagcttagttttgaaaaacattggtggattttcaggtaatctatgtaaaatcccattgcgcatgatatatctttttcttgctaagtcattacttttgacaagattgttgcttaatcctgccattgatagaagttcaagggtatggggtttgctgtctaaaaaaccatttggccctgcttctactatgaacccatcttcccgtgaggtctctattgaaccgccccacctcaatctcttttctatgattgttatttccatatccagattcagttcatttttcaaattttccaataaaaaagcggtggatatccctgatattccgcctcctattatggctactctcat

SEQ ID NO: 304 - DNA, 1488 bp, Candidatus
atggcgacggaacagcacagcggcagcaggcgtatcgtggtggtggggagcggcatcgcgggtctggctgccgcctatcggctgcaggagcggtgcgagcaggacggcccgccttgcgaggtgcgcgtattggaggccgctgcacggcccggcggtgcgatcagtaccacgcaccgggatggttttgttcttgaatctgggcccgataccattttcaccgataagccgtggggattggatctgatcagacgcctcggtctgagcgagcaggtcatcgggaccaatgaggcgcaccgccggacctttgttgtgcgggacggcgcactgcacccgctgcccgaagggttcgccttgatggggccgaccaagccttggccgtttctgcaatcagggctgctgtcatggcgcggcaaggcaagggcggctctggacctggtactgccgcgagggggaccatccgacgacgagagcctggcgtcgttcgttcggcgtcgtttcggacaggagtttctcgatcggctggcccaaccgatgatcggtggaatctatggcgccgacccggagcggttgagtctgcgcgctaccttcccgcagtttctgcagatggaagcgacgcatcgcagcgtgatcctcggcctgcgacgaatgcgccccgccggccgcggcgtaggtcataccagcagcggcccgcgctatggcctgtttgtcacgctggatcacgggctgcaggccctcgtcgatgccatggtaaaaaggctgccggctgggacgctgcgtctccgcgcgccggttgatagaatcgcgcacacagagcaaggctggaccgttcgacttggagacggcgcgagcctgcaggccgatggccttattctcgccgtccccgcatttgagattgccaggcttacccacgacctggaccaagacctggctcgtcagctcgaggccatgccctacgcctcttcggtcacgatcaatctggcctatcgtagagaggcgatccaccatccgctcgacgggtttggatttgtggtgccggcctgcgaggggcgcaccatcattgcctgttcgttcagcagcgtgaagttcgctcatcgggcgccggccggtcacgtcctgctgcgtgccttcgcgggcggcgcgctgcagccggagccgttcacctgggatgacgagacgctgctgagcgcagtgcgccgcgatctggaggagctgctggcgattcacgcgccgcctttgtggagccagttggtccgacatcctcgtgtgatgccccagtaccaggtcggccacctgggccggttggcggcgctcgaagagacgcttcggcggtggccgaccctcaagctgaccggtaacgcctacagaggtgtcggtgtgccggatgtggttcacagcggggagacggccgccgattcattattggcagagctggccccgtcaccgaccgagccgacccccgcttgtaccgaaggcgattctcgcctataa

SEQ ID NO: 305 - DNA, 1425 bp, Chloroflexus s
atgatggcgggatacgacagtgtagtgattggcggtggcattgccggtttagctgcggcttacacgctccacaagcgtggttatcgggtcctggtcatcgagtcgaccaatcgcgttggcggtgtgatccagaccatcaccacaccagaaggctacattctcgattgtgggccgaacacggtgggtaccggcgatgcgcgattgtggcaggaactgatcgatctgggtctgcgcgagcggatcacaccggcagcgccatgtagcaaacggcggttcatcctgatcaatggtacaccggttgaaatcccaacctcaccagtcgggctgattaccacgcgattactctcgtggcgggggaaattgcgggtactggccgaaccgttcatcaaccgtggatcgaccgatcccgatgaaagcgttgctgccttcttcacccgccggattggtgcagaggctaccgcccacctcctcgatccatttgttgccggcgtctacgctggcgatccgcaacggctctcgactgcggcagtctttccatcactgtgggaagcggcccagcgcagtggcagcatcgtgcgcggcatgctgagcaaacccaaaccgaagactcaggtgagtgagccaaagatgcgcagccgcacctttaccttccgcggtggcctggccgaatggccacgcgctctggcgcaagccctgggtgccggcaatgtctggacagaacggcgcgtggtcaagctccaaccacgcgactcctggtgggaagtgacgattgatggtgtgaacggcccggagacactcatcagtcgcagcctcattatcgccaccccagcctttacggcggctgatctcattgagtcggttgatcaaagagcggctggtgccctacgcggcattccgtatgcgccggtagcagtggtacatctcggctttcgtcgtgaccagatcagccaggaattgagcggctttggtgtgctggccccctcaagcgaacagcgtcagttcctcggcattctctggacatcaagcatcttcccgcacgttgcaccacacgatcatgtcctcaccacaaccctcagtggtggtgctatccggcccgaactggccgaacggagtgacgaaacactgattgaagcggccattcgcgatcatcaccagctcctggggatcagagggcaaccgatcttcacccatgttactcgctggcgaaccgccattgcccagtatacctttgggcaccgcgagcggattgccaccctcgtgcaactcgaacagcgcctgccgaccatccagtttgccggcagctaccgcgacggcgttggagtgcccaaaacctgggccagcggtgtgcaggcaggcgagcggatcgctgcggcactggcagcccatggaactaccgcagtttccacagagacggcgtcggggtga

SEQ ID NO: 306 - DNA, 546 bp, Escherichia
gtgaaaacattaattcttttctcaacaagggacggacaaacgcgcgagattgcctcctacctggcttcggaactgaaagaactggggatccaggcggatgtcgccaatgtgcaccgcattgaagaaccacagtgggaaaactatgaccgtgtggtcattggtgcttctattcgctatggtcactaccattcagcgttccaggaatttgtcaaaaaacatgcgacgcggctgaattcgatgccgagcgccttttactccgtgaatctggtggcgcgcaaaccggagaagcgtactccacagaccaacagctacgcgcgcaagtttctgatgaactcgcaatggcgtcccgatcgctgcgcggtcattgccggggcgctgcgttacccacgttatcgctggtacgaccgttttatgatcaagctgattatgaagatgtcaggcggtgaaacggatacgcgcaaagaagttgtctataccgattgggagcaggtggcgaatttcgcccgagaaatcgcccatttaaccgacaaaccgacgctgaaataa

SEQ ID NO: 307 - DNA, 900 bp, >280 EG1Escherichia
atgaaacccgacgcacaccaggttaaacagtttctgctcaaccttcaggatacgatttgtcagcagctgaccgccgtcgatggcgcagaatttgtcgaagatagttggcagcgcgaagctggcggcggcgggcgtagtcgggtgttgcgtaatggtggtgttttcgaacaggcaggcgtcaacttttcgcatgtccacggtgaggcgatgcctgcttccgccaccgctcatcgcccggaacttgccgggcgcagtttcgaggcgatgggcgtttcactggtagtgcatccgcataacccgtatgttcccaccagccacgcgaatgtgcggttttttattgccgaaaaaccgggtgccgatcccgtctggtggtttggcggtggcttcgacttaaccccattctatggttttgaagaagatgctattcactggcatcgcaccgcccgtgacctgtgcctgccatttggcgaagacgtttatccccgttacaaaaagtggtgcgacgaatacttctacctcaaacatcgcaacgaacagcgcggtattggcgggctgttctttgatgacctgaacacgccagatttcgaccgctgttttgcctttatgcaggcggtaggcaaaggctacaccgacgcttatttaccaattgtcgagcgacggaaagcgatggcctacggcgagcgcgagcgcaatttccagttatatcgtcgcggtcgttatgtcgagttcaatctggtctgggatcgcggcacgctgtttggcctgcaaactggcgggcgcaccgagtctatcctgatgtcaatgccgccactggtacgctgggaatatgattatcagccaaaagatggcagcccagaagcggcgttaagtgagtttattaaggtcagggattgggtgtaa

SEQ ID NO: 308 - DNA, 1326 bp, Hydrogenobacter
atgatagatgtagcggtagtaggggcaggtatatccgggctatccatagcctatcaccttaaaaaggctggacttgaggtaaaggtttttgaaaaagaagatgccgtaggtggaaacatacaaacagcatacatagacggttatgtttgcgagcttggacctcagaccattcttgcggacagtaaagtagaagagtttttaaaagatgcaggtataaagcccatatatgccaatccttcttccaaaaagagatacatatacaggaagggtaagttggtggctcttcctctatcacccgtagaatttctcttatcaccttttctgtccctcggcggaaagctaagagtcctcaaagagccttttgttccaaggtctcccaagcaggaagaaagtatagcggagtttgtcagaaggcgttttgggagggagtttttagattatgtagtagctcctttcgtgtctggagtttacgctggagacccagaggagctatctgttaaatacgcagttagaaaggtttacgagctggagcaaaagtacggaagcgttataaagggagccataaagctcaaagctcttggtccatcgggaaagctcatatcctttgaaggaggaaatgcaactcttataagaaagctctctgaaagtttagaggttcataaagagaatgtggttctgaggataaggagaaaggacgatatttttatcctagataccaaggaggggaaggttacggctaaggcggttgtagtttctactcctgccacatctacaggttatctgctcagggatctgtcttggagcatatccgaggagtttgacaaaatatactacgctcctgttctggtggtgcatgtggcagtaaagtttggtgttctgccagaaggctttggttttttagtgccaaaaaaggaaaacaaaaggatactgggggtgatcttttcatctaatctttttgaaggaaggagtccagagggcaagagtcttatcaccgtatatattggtggtgccacagacccagaaataatagaatacgaagatgaagccattgtaagtgtgctggagagggaactaagagagaccgtagatataagagactgggatcttttaaaaataacgcgctggaaaaagggtataccccaatacactgtggggtacggaaggtatcttgagctggcaaactccatagagatggagcaacccggacttttcttgagtggcaattatctttatggtgtttccgttgcagactgtataagagtttcacatcacatagcaaagagggtaatagactttttggaagttaaggggcgtactgttgtataa

SEQ ID NO: 309 - DNA, 1323 bp, Laribacter
tcagctggccggcgggtagtccagcaagcactggacagccacctgctgccccttgtcgagacagtcgacgaccgataccccgccatgccagttggcacacacgcggataccgtgttcatgcaggtcactgaccgcgctggccagcggcagggcatggctgtcgtactgcggaatggcctgctcctgacgggtcagccggcaaagggtcggctcgccctggatgcggtagagccgccgcagttcttccagcgccagcgccaccagcgtggcgtcatcgtgccggtaacggtcaaggaactgcatgccgccgacaaaggtggtcagcagggtttcgcctgccggcgtgcggtcgggaaacagcgagccggaccagatggagccggcggcaaacggtttttcgactttggggttcagcccgccaaaaccgtcgaggtcatgcccgaccgtgctgcgtggccaggccgtatgcaggacggccaccggggcgtaggttacgttggcaaggttcgctgcaatggccggaaaatggctggccagcagttgcccggccacgtcggccggcacggccagcaccacttcgtcggcgtccagttcacctgctggggttctgacccgccagccggtttccagccgctccagtgcctgcaccgacgtatccagccgtacgtccagcccctgcgccagcgtttcgggcagctgctgcaaaccctcgttcagggtgaaggtggccttgcgccggaaggttttgcggcgggcaaacatgccgcgcacgatggagcctgactggcgctcggcttcgtggatgaccggcagcgtcagtccggccaccagctcttcgggatcaccggcaaaaatgccgccgacaaacggcgaaatggcccgctcgacaaattcgtcgcccagacgacgccggaaaaaggcagccacggtttccggctcacgcaccggccggttgcgccggaaaggctcggtcagcgccagccatttgctccgggcaccgaactgcgatccggtcaggaacgacagcggtccggacggcagggcctcgtagcgatcgccgcgcagcacgaaacggtgccggaccacggccgccgccggccggatggctgccgtgaggcccagccgttccagaaggtccagatgcccggcatggccgtaaagggtattggggccgagttccagccggtaaccgtcggccgctaccgtcccgatcttgccgccgacccggctgccggcctccagcaccacgacggggatgccccgctgttgcaggtgccaggcacacgacaggccggaaatgccggcaccgatcaccaccaccat

SEQ ID NO: 310 - DNA, 1404 bp, Opitutus
ctattgcccggcgcgttccgccagtttttcgccggccgcgatgcaggccgggacggcgatcccgtcgcgggcctgtccccccatgaacagtcccggatggaagcgttcgccggcggcaagagcggcgatgaagtgctcgtgaccgaggttgtactgcgggatggcgcgaggccagaagttgtgccggacaaaaaccgggtcgccgctgacgccgagcaactgcgtgagatcgggccgcacggcggcaagcagctgatcggcgggcaggctggcgagttgcggctggcgtgttccgcccaccatcaccgtcagcgccacgtgtcccagcggcgcgcggcccgggaacagcgaggacgagaacagcacgccaaggaccgagcgcttctcgacggccggcacgagcacgccgaacccgtcgagcggatgcgcgacctgctcgcggcggaagccgaggaagagcgacgagaccggcgggtgttcgatcagcgccagcgcggcgagcggcttttcgccgagcgtgccgatctggagtcgcgcgagggcgggcgcgggcagcgcgaccacgacgctgtcgaagctttgcgtgtgcgtcgccacgtcgtcgtgccaaaccacgttccacttgtcgccgggcacgatggcgtcgagcgaagcgccgagtgtgatggcgccggcggggagacgcgcggcgagcgcctccggcagcacgtgcaggccgtgtttgaaggaaaagatgccggggcgcggctcaccgcgggccttccgggctttggccgcggcgatctggccgcggatcagcgagccgtgggtttgttcgatttcccagagcttggggaacgactgccgcgcggagagcttttcgggatcgccggcatacacgccgcccacgaacggattgagcgcgtagtcgacgaactcgcgcccgaagtgcgactcgacgaattcggcgaggctgacgtcggtcgtgcggacgcgccgccgggcgaacagctcggcgaggagcttgaacttggcgacgggcgaaaacagtgaggaggcgaagaacgacggtggggacatcggcgcggccagcgcgcggccgcggcgaacgatgtagcggtttttcgcggcgggatccgcggcgatgcgttcgccgttcagcccgagttcgtcgatgagcttgtcgacggcgagttcgccggagagcagcgtgttgggtccgccttcgatcagccagccgtcgacttcctccgtcttgatcgagccgccgacgcggtcggattgctcgaacacgcgcaccttgtggccgagctgggtgagccggtgggcggcggtgagcccggtgatgccggcgccaagcacggcgaacgttttgggcggccggcctgaggcggtggcggaaggattaaaaggcgaggtgctcat

SEQ ID NO: 311 - DNA, 1410 bp, Rhodothermus
atggcttctgtgggaatcatcggagccggcattgccggtctgacggccgcctacgaactgcaccgtcgtggcctggaagtgacggtctttgaagccaccgaccgcatcggcggcttcattcagtcggagcggatcgacggctttctggtggagctcggtcctcagacgctccagcgcacctcgggcgacttcgaagagttgctgcgacaggtggatctggaggacgcgtgcattccggcccgaccggtcgcggcgaatcgcttcatcgtgcggggtggccagccgatacccctgccacgctcgccgcgcgaactgctgcgcacgccgctgctttcgccccgggcgcgcctgcgcctgctggccgagccgttcattcaccgggcccaccggagcaccgaggaaagcgtggccaaattcacccggcgtcgactgggtccggaggtgctcgactatctggtagagcccttcgtggccggcatctttgcgggcgatcccgagcagctttcggtgcgctacgccttcccgaaactgttcgaactggagcagcagtacggctcgcttttctggggcctgatccgcgatcggatgaagcagcggtatcatccggccccgcgccgctcgatgttctcgtttgtcgagggcctgcacatgctgccccgggcgctggccgagcggttgcccgcgcacgcgatcgtgcgcaacgcggaggtgctggccatccgctgggacgagaaaaacccctggacgctcacgttccggcagcacggccgcgcttcgacccgttttttcgatatcatcgtctgtgccgtgccgctacaccggctggcgcaactccggattcatcccccggtggatcgccggccgctcagcaccgtcgagcacccgcccattgcgctggtggcgctgggcttccggcgcgagcaggtggcccatccgctggacggcttcgggatgctggtaccggccgtggagcgcgactttcagattctgggcacgctgttctcctcgtcgctctttccggaccgggcgcccgaaggccacgtgctgctgaccacgttcgtcggcggcatgcggcatcccgaactggcgttgctgcccgaagatcggctggaggcgctggtgctgcaggacctgcgccggctgctgggcatctcgggcgcgccggtcttccggcacgtgtggcgctgggagcgctcgatcccgcagtaccggctgggctacgatgcggtgctcgcctgcgttcacgatgtggaaatgagccgctccggtctgtttctggccggcaactacatggaaggcatctccgtgatcgacgcgctccataccggcctgaaggccgcccgcgcgatcatccagcacctgcgcgaagaagcagccggcggtctggccaagctggtgctgggagattga

SEQ ID NO: 312 - protein, 150 aa, Acinetobacter baylyi; identical to SEQ ID NO: 84

SEQ ID NO: 313 - protein, 398 aa, Escherichia coli
MLKVLLLFVLLIAGIVVGPMIAGHQGYVLIQTDNYNIETSVTGLAIILILAMVVLFAIEWLLRRIFRTGAHTRGWFVGRKRRRARKQTEQALLKLAEGDYQQVEKLMAKNADHAEQPVVNYLLAAEAAQQRGDEARANQHLERAAELAGNDTIPVEITRVRLQLARNENHAARHGVDKLLEVTPRHPEVLRLAEQAYIRTGAWSSLLDIIPSMAKAHVGDEEHRAMLEQQAWIGLMDQARADNGSEGLRNWWKNQSRKTRHQVALQVAMAEHLIECDDHDTAQQIIIDGLKRQYDDRLLLPIPRLKTNNPEQLEKVLRQQIKNVGDRPLLWSTLGQSLMKHGEWQEASLAFRAALKQRPDAYDYAWLADALDRLHKPEEAAAMRRDGLMLTLQNNPPQ

SEQ ID NO: 314 - DNA, 1197 bp, Escherichia coli
atgctaaaagtgttattgctctttgtgttgctgattgcggggatcgtggttggcccgatgattgccggccatcagggttatgtgctgatccagaccgacaactacaatatcgaaaccagcgtcacgggcctggcgatcatattgattctggcgatggtagtgctgtttgccattgagtggctactgcggcggatcttccgcactggcgcgcacacccgtgggtggtttgtcggacgtaagcgtcgccgtgcacgtaagcagaccgaacaggcgctgctgaaactggcggaaggcgattatcagcaagttgaaaagctgatggcgaaaaatgccgatcacgcggaacaaccggtggtgaactatctactggctgccgaagccgcgcaacaacgtggtgatgaagcacgcgccaaccaacatctggaacgcgcagcggagctggccggcaacgacaccattccggtagaaatcacccgcgtacgtctgcaactggcccgtaatgaaaaccatgctgcacgccacggcgtggataagctgctggaagttacgccacgccatccggaagtattacgtctggcggaacaggcgtatatccgcacaggtgcatggagttcgctgctggatattatcccatcaatggcgaaagcccatgttggtgatgaagaacatcgtgcaatgctggaacaacaggcatggattggcctgatggatcaggcgcgtgccgataacggtagcgaaggtttgcgtaactggtggaaaaaccaaagccggaaaacgcgtcatcaggtagcgttgcaggtggcaatggcggaacatcttattgaatgtgacgatcatgatactgcccagcaaattatcatcgatggcctgaaacgccagtacgacgatcgcctactgctgccgattcctcgactgaaaacaaacaatccggaacagctggaaaaagtgctgcgccagcaaatcaaaaacgtcggcgatcgcccgctgttgtggagcacactgggccagtcactgatgaagcacggagaatggcaggaagcatcgctcgccttccgcgcagcgctgaaacaacgtccggacgcctacgattacgcatggcttgccgacgcgctggacagactgcacaagccggaagaagctgcagctatgcgtcgcgacggtttgatgttaacgttgcagaataacccgccacagtag

SEQ ID NO: 315 - protein, 503 aa, Artificial Sequence
  Synthetic Polypeptide
MAASDDPRGGRSVAVVGAGVSGLAAAYRLRKRGVQVTVFEAADRAGGKLRTNSEGGFIWDEGANTMTESELEASRLIDDLGLQGKQQYPNSQHKRYIVKDGAPTLIPSDPIALMKSTVLSTKSKLFLEPFLYEKSSRRTSGKVSDEHLSESMFSDQREYICSVIFLCICRDNQVVDYLLDFFVAGTSGGDPESLSIRHAFPALWNLENKYGSVIAGALLSKLSTKGDSVKTGGASPGKGRNKRVSFSFHGGMQSKLDALHNEVGDGNVKLGTEVLSLACCCDGVSSSGGWSISVDSKDAKGKDLRKNQSFDAVIMTAPLSNVQRMKFTKGGVPFVLDFLPKVDYLPLSLMVTAFKKEDVKKPLEGFGALIPYKEQQKHGLKTLGTLFSSMMFPDRAPNDQYLYTSFIGGSHNRDLAGAPTAILKQLVTSDLRKLLGVEGQPTFVKHVHWRNAFPLYGQNYDLVLEAIAKMENNLPGFFYAGKSMKAPLLYKRNLRYLKHIPVD

SEQ ID NO: 316 - protein, 530 aa, Artificial Sequence
  Synthetic polypeptide
MVILPVSQLSTNLGLSLVSPTKNNPVMGNVSERNQVNQPISAKRVAVVGAGVSGLAAAYKLKSNGLNVTLFEADSRAGGKLKTVVKDGLIWDEGANTMTESDEEVTSLFDDLGIREKLQLPISQNKRYIARDGLPVLLPSNPVALLKSNILSAKSKLQIMLEPFLWKKHNGAKVSDENAQESVAEFFERHFGKEFVDYLIDPFVAGTSGGDPQSLSMRHAFPELWNIENRFGSVISGFLQSKLSSKKEKGGEKQSSNKKPRVRGSFSFQGGMQTLVDTICKEFGEDELKLQSEVLSLSYSHNGSLTSENWSVSSMSNSTIQDQPYDAVVVTAPINNVKELKIMKVENPFSLDFIPEVSCLPLSVIITTFKKTNVKRPLEQFGVLVPSNEDHNGLKTLGTLFSSMMFPDRAPSDVVLTTFVGGSRNFELAKASTDELKQIVSSDLQQLLGTEGEPTFVNHFVWSKAFPLQGRNYDSVLRAIEKMERDLPGLFYAGNHKGGLSVGKSIASGYKAAELAISYLESNKMTEEII

SEQ ID NO: 317 - protein, 496 aa, Artificial Sequence
  Synthetic Polypeptide
MAPSAGEDKHSSAKRVAVIGAGVSGLAAAYKLKIHGLNVTVFEAEGKAGGKLRSVSQDGLIWDEGANTMTESEGDVTFLIDSLGLREKLQLPISQNKRYIARDGLPVLLPSNPVALLKSNILSAKSKLQIMLEPFLWKKHNESVSGFFQRHFGKEVVQYLLDPFVAGTCGGDPDSLSMHHSFPELWNLEKRFGSVILGAIRSKLSPKNEKKQGPPKTSANKKRQRGSFSFLGGMQTLTDAICKDLREDELRLNSRVLELSCSCTEDSAIDSWSIISASPHKRQSEEESFDAVIMTAPLCDVKSMKIAKRGNPFLLNFIPEVDYVPLSVVITTFKRENVKYPLEGFGVLVPSKEQQHGLKTLGTLFSSMMFPDRAPNNVYLYTTFVGGSRNRELAKASRTELKEIVTSDLKQLLGAEGEPTYVNHLYWSKAFPLYGHNYDSVLDAIDKMEKNLPGLFYAGNHRGGLSVGKALSSGCNAADLVISYLESVSTDSKRHC

SEQ ID NO: 318 - protein, 471 aa, Artificial Sequence
  Synthetic Polypeptide
MHHMPRTTGMNVAVVGGGISGLAVAHHLRSRGTDAVLLESSARLGGAVGSHALAGVLVEQGPNSFLDREPATRALAAALNLEGRIRAADPAAKRRYVYTRGRLRSVPASPPAFLASDILPLGARLRVAGSLFSRRAPEGVDESLAAFGRRHLGHRATQVLLDAVQTGIYAGDVEQLSVAATFPMLVKMEREHRSLILGAIRAQKAQRQAALPAGTAPKLSGALSTFDGGLQVLIDALAASLGDAAHVGARVEGLAREDGGWRLIIEEHGRRAELSVAQVVLAAPAHATAKLLRPLDDALAALVAGIAYAPIAAVHLGFDAGTLPAPDGFGFLVPAEEDRRMLGAIHASTTFPFRAEGGRVLYSCMVGGARQPGLVEQDEDALAALAREELKALAGVTARPSFTRVFRWPLGIPQYNLGHLERVAAIDAALQRLPGLHLIGNAYKGVGLNDCIRNAAQLADALVAGNTSHAP

SEQ ID NO: 319 - protein, 504 aa, Artificial Sequence
  Synthetic Polypeptide
MAPSAGEDKHSSAKRVAVIGAGVSGLAAAYKLKIHGLNVTVFEAEGKAGGKLRSVSQDGLIWDEGANTMTESEGDVTFLIDSLGLREKQQFPLSQNKRYIARNGTPVLLPSNPIDLIKSNFLSTGSKLQMLLEPILWKNKKLSQVSDSHESVSGFFQRHFGKEVVDYLIDPFVAGTCGGDPDSLSMHHSFPELWNLEKFRGSVILGAIRSKLSPKNEKKQGPPKTSANKKRQRGSFSFLFFMQTLTDAICKDLREDELRLNSRVLELSCSCTEDSAIDSWSIISASPHKRQSEEESFDAVIMTAPLCDVKSMKIAKRGNPFLLNFIPEVDYVPLSVVITTFKRENVKYPLEGFGVLVPSKEQQHGLKTLGTLFSSMMFPDRAPNNVYLYTTFVGGSRNRELAKASRTELKEIVTSDLKQLLGAEGEPTYVNHLYWSKAFPLYGHNYDSVLDAIDKMEKNLPGLFYAGNHRGGLSVGKALSSGCNAADLVISYLESVSTDSKRHC

SEQ ID NO: 320 - protein, 478 aa, Artificial Sequence
  Synthetic Polypeptide
MDHHHHHHHHMPRTTGMNVAVVGGGISGLAVAHHLRSRGTDAVLLESSARLGGAVGTHALAGRLVEQGPNSFLDREPATRALAAALNLEGRIRAADPAAKRRYVYTRGRLRSVPASPPAFLASDILPLGARLRVAGELFSRRAPEGVDESLAAFGRRHLGHRATQVLLDAVQTGIYAGDVEQLSVAATFPMLVKMEREHRSLILGAIRAQKAQRQAALPAGTAPKLSGALSTFDGGLQVLIDALAASLGDAAHVGARVEGLAREDGGWRLIIEEHGRRAELSVAQVVLAAPAHATAKLLRPLDDALAALVAGIAYAPIAVVHLGFDAGTLPAPDGFGFLVPAEEQRRMLGAIHASTTFPFRAEGGRVLYSCMVGGARQPGLVEQDEDALAALAREELKALAGVTARPSFTRVFRWPLGIPQYNLGHLERVAAIDAALQRLPGLHLIGNAYKGVGLNDCIRNAAQLADALVAGNTSHAP

SEQ ID NO: 321 - protein, 534 aa, Artificial Sequence; identical to SEQ ID NO: 1
  Synthetic Polypeptide

SEQ ID NO: 322 - protein, 509 aa, Artificial Sequence
  Synthetic polypeptide
MGNISEREEPTSAKRVAVVGAGVSGLAAAYKLKSHGLSVTLFEADSRAGGKLKTVKKDGFIWDEGANTMTESEAEVSSLIDDLGLREKQQLPISQNKRYIARDGLPVLLPSNPAALLTSNILSAKSKLQIMLEPFLWRKHNATELSDEHVQESVGEFFERHFFERHFGKEFVDYVIDPFVAGTCGGDPQSLSMHHTFPEVWNIEKRFGSVFAGLIQSTLLSKKEKGGENASIKKPRVRGSFSFQGGMQTLVDTMCKQLGEDELKLQCEVLSLSYNQKQIPSLGNWSVSSMSNNTSEDQSYDAVVVTAPIRNVKEMKIMKFGNPFSLDFIPEVTYVPLSVMITAFKKDKVKRPLEGFGVLIPSKEQHNGLKTLGTLFSSMMFPDRAPSDMCLFTTFVGGSRNRKLANASTDELKQIVSSDLQQLLGTEDEPSFVNHLFWSNAFPLYGHNYDSVLRAIDKMEKDLPGFFYAGNHKGGLSVGKAMASGCKAAELVISYLDSHIYVKMDEKTA

The invention claimed is:

1. A method for controlling undesired vegetation at a plant cultivation site, the method comprising the steps of:

a) providing, at said site, a plant that comprises a nucleic acid encoding a protoporphyrinogen oxidase (PPO), wherein expression of the nucleic acid in the plant results in increased tolerance to 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione as compared to a wild type control plant, and wherein the encoded PPO comprises the amino acid sequence of SEQ ID NO: 184; and b) applying to said site an effective amount of 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione.

2. The method according to claim 1, wherein the plant comprises at least one additional heterologous nucleic acid comprising a nucleotide sequence encoding a herbicide tolerance enzyme.

3. The method according to claim 2, wherein 1,5-dimethyl-6-thioxo-3-(2,2,7-trifluoro-3-oxo-4-(prop-2-ynyl)-3,4-dihydro-2H-benzo[b][1,4]oxazin-6-yl)-1,3,5-triazinane-2,4-dione is applied in conjunction with one or more additional herbicides.

* * * * *